United States Patent
Ghayur et al.

(10) Patent No.: US 9,029,508 B2
(45) Date of Patent: May 12, 2015

(54) DUAL VARIABLE DOMAIN IMMUNOGLOBULINS AND USES THEREOF

(75) Inventors: Tariq Ghayur, Holliston, MA (US); Susan E. Morgan-Lappe, Chicago, IL (US); Edward B. Reilly, Libertyville, IL (US); Gillian A. Kingsbury, Wayland, MA (US); Andrew Phillips, Libertyville, IL (US); Jieyi Wang, Lake Bluff, IL (US); Randy L. Bell, Lindenhurst, IL (US); Suzanne M. Norvell, Long Grove, IL (US); Yingchun Li, Buffalo Grove, IL (US); Junjian Liu, Norwich, CT (US); Hua Ying, Holden, MA (US)

(73) Assignee: AbbVie Inc., North Chicago, IL (US)

( * ) Notice: Subject to any disclaimer, the term of this patent is extended or adjusted under 35 U.S.C. 154(b) by 322 days.

(21) Appl. No.: 12/431,460

(22) Filed: Apr. 28, 2009

(65) Prior Publication Data

US 2010/0076178 A1    Mar. 25, 2010

Related U.S. Application Data

(60) Provisional application No. 61/125,834, filed on Apr. 29, 2008, provisional application No. 61/134,283, filed on Jul. 8, 2008, provisional application No. 61/197,191, filed on Oct. 23, 2008, provisional application No. 61/199,009, filed on Nov. 12, 2008.

(51) Int. Cl.
| | |
|---|---|
| *C07K 16/00* | (2006.01) |
| *C12P 21/08* | (2006.01) |
| *C07H 21/04* | (2006.01) |
| *G01N 33/53* | (2006.01) |
| *C12N 15/09* | (2006.01) |
| *C12P 21/04* | (2006.01) |
| *C12N 5/02* | (2006.01) |
| *C12N 5/06* | (2006.01) |
| *C12N 1/20* | (2006.01) |
| *C12N 15/00* | (2006.01) |
| *A61K 39/395* | (2006.01) |
| *A61K 39/40* | (2006.01) |
| *C07K 16/46* | (2006.01) |
| *C07K 16/22* | (2006.01) |
| *C07K 16/28* | (2006.01) |
| *C07K 16/32* | (2006.01) |
| *C07K 1/00* | (2006.01) |
| *A61K 39/00* | (2006.01) |

(52) U.S. Cl.
CPC ......... *C07K 16/468* (2013.01); *A61K 2039/505* (2013.01); *C07K 16/22* (2013.01); *C07K 16/28* (2013.01); *C07K 16/2863* (2013.01); *C07K 16/32* (2013.01); *C07K 2316/96* (2013.01); *C07K 2317/31* (2013.01); *C07K 2317/64* (2013.01); *C07K 2317/71* (2013.01); *C07K 2317/73* (2013.01); *C07K 2317/732* (2013.01); *C07K 2317/734* (2013.01); *C07K 2317/92* (2013.01); *C07K 2319/00* (2013.01); *Y10S 435/81* (2013.01)

(58) Field of Classification Search
None
See application file for complete search history.

(56) References Cited

U.S. PATENT DOCUMENTS

| | | | |
|---|---|---|---|
| 4,526,938 A | 7/1985 | Churchill et al. |
| 4,699,784 A | 10/1987 | Shih et al. |
| 4,753,894 A | 6/1988 | Frankel et al. |
| 4,816,567 A | 3/1989 | Cabilly et al. |
| 4,943,533 A | 7/1990 | Mendelsohn et al. |
| 4,946,778 A | 8/1990 | Ladner et al. |
| 4,980,286 A | 12/1990 | Morgan et al. |
| 5,128,326 A | 7/1992 | Balazs et al. |
| 5,223,409 A | 6/1993 | Ladner et al. |
| 5,225,539 A | 7/1993 | Winter |
| 5,258,498 A | 11/1993 | Huston et al. |
| 5,290,540 A | 3/1994 | Prince et al. |
| 5,403,484 A | 4/1995 | Ladner et al. |
| 5,427,908 A | 6/1995 | Dower et al. |
| 5,500,362 A | 3/1996 | Robinson et al. |
| 5,516,637 A | 5/1996 | Huang et al. |
| 5,530,101 A | 6/1996 | Queen et al. |
| 5,558,864 A | 9/1996 | Bendig et al. |
| 5,565,332 A | 10/1996 | Hoogenboom et al. |
| 5,565,352 A | 10/1996 | Hochstrasser et al. |
| 5,571,698 A | 11/1996 | Ladner et al. |
| 5,580,717 A | 12/1996 | Dower et al. |
| 5,585,089 A | 12/1996 | Queen et al. |
| 5,624,821 A | 4/1997 | Winter et al. |
| 5,627,052 A | 5/1997 | Schrader |

(Continued)

FOREIGN PATENT DOCUMENTS

| | | |
|---|---|---|
| CN | 1276428 A | 12/2000 |
| CN | 101058609 A | 10/2007 |

(Continued)

OTHER PUBLICATIONS

Alt, Muller, and Kontermann. Novel tetravalent and bispecific IgG-like antibody molecules combining single-chain diabodies with the immunoglobulin gamma1 Fc or CH3 region. FEBS Letters, 1999. vol. 454, pp. 90-94.*

Miller, Meng, Liu, Hurst, Hsei, Wong, Ekert, Lawrence, Sherwood, De Forge, Gaudreault, Keller, Sliwkowski, Ashkenazi, and Presta. Design, construction and in vitro analysis of multivalent antibodies. Journal of Immunology, 2003. vol. 170, pp. 4854-4861.*

Alderson et al., "Regulation of apoptosis and T cell activation by Fas-specific mAb," *Int. Immunol.*, 6(11): 1799-1806 (1994).

Ames et al., "Conversion of murine Fabs isolated from a combinatorial phage display library to full length immunoglobulins," *J. Immunol. Methods*, 184: 177-186 (1995).

Aoki et al., "Endothelial Progenitor Cell Capture by Stents Coated with Antibody Against CD34," *J. Am. Coll. Cardiol.*, 45(10): 1574-1579 (2005).

Arancio et al., "RAGE potentiates Aβ-induced perturbation of neuronal function in transgenic mice," *EMBO J.*, 23: 4096-4105 (2004).

Arndt et al., "Bispecific Diabodies for Cancer Therapy," *Methods Mol. Biol.*, 207: 305-321 (2003).

(Continued)

*Primary Examiner* — Chun Dahle
(74) *Attorney, Agent, or Firm* — Finnegan, Henderson, Farabow, Garrett & Dunner, LLP

(57) ABSTRACT

The present invention relates to engineered multivalent and multispecific binding proteins, methods of making, and specifically to their uses in the prevention, diagnosis, and/or treatment of disease.

22 Claims, 1 Drawing Sheet

(56) References Cited

U.S. PATENT DOCUMENTS

| | | |
|---|---|---|
| 5,641,870 A | 6/1997 | Rinderknecht et al. |
| 5,648,260 A | 7/1997 | Winter et al. |
| 5,658,727 A | 8/1997 | Barbas et al. |
| 5,677,171 A | 10/1997 | Hudziak et al. |
| 5,679,377 A | 10/1997 | Bernstein et al. |
| 5,693,762 A | 12/1997 | Queen et al. |
| 5,698,426 A | 12/1997 | Huse |
| 5,714,350 A | 2/1998 | Co et al. |
| 5,714,352 A | 2/1998 | Jakobovits |
| 5,723,323 A | 3/1998 | Kauffman et al. |
| 5,733,743 A | 3/1998 | Johnson et al. |
| 5,736,137 A | 4/1998 | Anderson et al. |
| 5,763,192 A | 6/1998 | Kauffman et al. |
| 5,766,886 A | 6/1998 | Studnicka et al. |
| 5,776,456 A | 7/1998 | Anderson et al. |
| 5,780,225 A | 7/1998 | Wigler et al. |
| 5,789,554 A | 8/1998 | Leung et al. |
| 5,795,965 A | 8/1998 | Tsuchiya et al. |
| 5,814,476 A | 9/1998 | Kauffman et al. |
| 5,817,483 A | 10/1998 | Kauffman et al. |
| 5,821,047 A | 10/1998 | Garrard et al. |
| 5,824,514 A | 10/1998 | Kauffman et al. |
| 5,846,765 A | 12/1998 | Matthews et al. |
| 5,849,500 A | 12/1998 | Breitling et al. |
| 5,855,913 A | 1/1999 | Hanes et al. |
| 5,863,765 A | 1/1999 | Berry et al. |
| 5,874,064 A | 2/1999 | Edwards et al. |
| 5,891,996 A | 4/1999 | Mateo de Acosta del Rio et al. |
| 5,912,015 A | 6/1999 | Bernstein et al. |
| 5,916,597 A | 6/1999 | Lee et al. |
| 5,916,771 A | 6/1999 | Hori et al. |
| 5,929,212 A | 7/1999 | Jolliffe et al. |
| 5,934,272 A | 8/1999 | Lloyd et al. |
| 5,939,598 A | 8/1999 | Kucherlapati et al. |
| 5,959,083 A | 9/1999 | Bosslet et al. |
| 5,969,108 A | 10/1999 | McCafferty et al. |
| 5,976,862 A | 11/1999 | Kauffman et al. |
| 5,985,309 A | 11/1999 | Edwards et al. |
| 5,985,320 A | 11/1999 | Edwards et al. |
| 5,985,588 A | 11/1999 | Breitling et al. |
| 5,985,615 A | 11/1999 | Jakobovits et al. |
| 5,989,463 A | 11/1999 | Tracy et al. |
| 5,989,830 A * | 11/1999 | Davis et al. .............. 435/7.1 |
| 5,998,209 A | 12/1999 | Jokobovits et al. |
| 6,019,968 A | 2/2000 | Platz et al. |
| 6,057,098 A | 5/2000 | Buechler et al. |
| 6,066,719 A | 5/2000 | Zapata |
| 6,075,181 A | 6/2000 | Kucherlapati et al. |
| 6,090,382 A | 7/2000 | Salfeld et al. |
| 6,091,001 A | 7/2000 | Jakobovits et al. |
| 6,114,598 A | 9/2000 | Kucherlapati et al. |
| 6,127,132 A | 10/2000 | Breitling et al. |
| 6,130,364 A | 10/2000 | Jakobovits et al. |
| 6,180,370 B1 | 1/2001 | Queen et al. |
| 6,204,023 B1 | 3/2001 | Robinson et al. |
| 6,214,984 B1 | 4/2001 | Zapata |
| 6,235,883 B1 | 5/2001 | Jakobovits et al. |
| 6,239,259 B1 | 5/2001 | Davis et al. |
| 6,258,562 B1 | 7/2001 | Salfeld et al. |
| 6,350,861 B1 | 2/2002 | Co et al. |
| 6,387,627 B1 | 5/2002 | Breitling et al. |
| 6,491,916 B1 | 12/2002 | Bluestone et al. |
| 6,506,883 B2 | 1/2003 | Meteo de Acosta del Rio et al. |
| 6,509,015 B1 | 1/2003 | Salfeld et al. |
| 6,639,055 B1 | 10/2003 | Carter et al. |
| 6,660,843 B1 | 12/2003 | Feige et al. |
| 6,699,473 B2 | 3/2004 | Raisch et al. |
| 6,699,658 B1 | 3/2004 | Wittrup et al. |
| 6,730,483 B2 | 5/2004 | Breitling et al. |
| 6,818,392 B2 | 11/2004 | Lou et al. |
| 6,884,879 B1 | 4/2005 | Baca et al. |
| 6,914,128 B1 | 7/2005 | Salfeld et al. |
| 6,986,890 B1 | 1/2006 | Shitara et al. |
| 7,060,269 B1 | 6/2006 | Baca et al. |
| 7,060,808 B1 | 6/2006 | Goldstein et al. |
| 7,070,775 B2 | 7/2006 | Le et al. |
| 7,179,892 B2 | 2/2007 | Basi et al. |
| 7,202,343 B2 | 4/2007 | Gudas et al. |
| 7,247,301 B2 | 7/2007 | van de Winkel et al. |
| 7,247,304 B2 | 7/2007 | van de Winkel et al. |
| 7,258,857 B2 | 8/2007 | Stern et al. |
| 7,317,091 B2 | 1/2008 | Lazar et al. |
| 7,438,911 B2 | 10/2008 | Shitara et al. |
| 7,446,175 B2 | 11/2008 | Gram et al. |
| 7,449,616 B2 | 11/2008 | Pons et al. |
| 7,491,516 B2 | 2/2009 | Collinson et al. |
| 7,528,236 B2 | 5/2009 | Fong et al. |
| 7,566,772 B2 | 7/2009 | Green et al. |
| 7,592,429 B2 | 9/2009 | Paszty et al. |
| 7,612,181 B2 | 11/2009 | Wu et al. |
| 7,727,527 B2 | 6/2010 | Shelton |
| 7,790,858 B2 | 9/2010 | Presta |
| 7,863,419 B2 | 1/2011 | Taylor et al. |
| 7,928,205 B2 | 4/2011 | Dillon et al. |
| 8,258,268 B2 | 9/2012 | Wu et al. |
| 8,389,237 B2 | 3/2013 | Skerry et al. |
| 8,586,714 B2 | 11/2013 | Ghayur et al. |
| 8,716,450 B2 | 5/2014 | Ghayur et al. |
| 8,722,855 B2 | 5/2014 | Ghayur et al. |
| 8,735,546 B2 | 5/2014 | Ghayur et al. |
| 2002/0004587 A1 | 1/2002 | Miller et al. |
| 2002/0127231 A1 * | 9/2002 | Schneck et al. ............ 424/178.1 |
| 2002/0136719 A1 | 9/2002 | Shenoy et al. |
| 2002/0137134 A1 | 9/2002 | Gerngross |
| 2003/0039645 A1 | 2/2003 | Adair et al. |
| 2003/0091561 A1 | 5/2003 | van de Winkel et al. |
| 2003/0092059 A1 | 5/2003 | Salfeld et al. |
| 2003/0118583 A1 | 6/2003 | Emery et al. |
| 2003/0186374 A1 | 10/2003 | Hufton et al. |
| 2003/0206898 A1 | 11/2003 | Fischkoff et al. |
| 2004/0018590 A1 | 1/2004 | Gerngross et al. |
| 2004/0038339 A1 | 2/2004 | Kufer et al. |
| 2004/0133357 A1 | 7/2004 | Zhong et al. |
| 2004/0162411 A1 | 8/2004 | Lanzavecchia |
| 2004/0219144 A1 | 11/2004 | Shelton |
| 2004/0237124 A1 | 11/2004 | Pons et al. |
| 2004/0241745 A1 | 12/2004 | Honjo et al. |
| 2005/0026881 A1 | 2/2005 | Robinson et al. |
| 2005/0038231 A1 | 2/2005 | Fahrner et al. |
| 2005/0042664 A1 | 2/2005 | Wu et al. |
| 2005/0095246 A1 | 5/2005 | Shafer |
| 2005/0118643 A1 | 6/2005 | Burgess et al. |
| 2005/0147610 A1 | 7/2005 | Ghayur et al. |
| 2005/0215769 A1 | 9/2005 | Breece et al. |
| 2005/0260204 A1 | 11/2005 | Allan |
| 2006/0002923 A1 | 1/2006 | Uede et al. |
| 2006/0024300 A1 | 2/2006 | Adams et al. |
| 2006/0041058 A1 | 2/2006 | Yin et al. |
| 2006/0067930 A1 | 3/2006 | Adams et al. |
| 2006/0093599 A1 | 5/2006 | Gazit-Bornstein et al. |
| 2006/0104968 A1 | 5/2006 | Bookbinder et al. |
| 2006/0134105 A1 | 6/2006 | Lazar et al. |
| 2006/0233791 A1 | 10/2006 | Tedder et al. |
| 2006/0246071 A1 | 11/2006 | Green et al. |
| 2006/0253100 A1 | 11/2006 | Burright et al. |
| 2006/0280747 A1 * | 12/2006 | Fuh et al. .................. 424/155.1 |
| 2007/0041905 A1 | 2/2007 | Hoffman et al. |
| 2007/0071675 A1 | 3/2007 | Wu et al. |
| 2007/0071745 A1 | 3/2007 | Umaña et al. |
| 2007/0072225 A1 | 3/2007 | Alving |
| 2007/0092507 A1 | 4/2007 | Balthasar et al. |
| 2007/0092520 A1 | 4/2007 | Dennis et al. |
| 2007/0110747 A1 | 5/2007 | Paszty et al. |
| 2007/0123479 A1 | 5/2007 | Kufer et al. |
| 2007/0196376 A1 | 8/2007 | Raeber et al. |
| 2007/0232556 A1 | 10/2007 | Montine et al. |
| 2007/0286858 A1 | 12/2007 | Clancy et al. |
| 2007/0292420 A1 | 12/2007 | Giles-Komar et al. |
| 2008/014196 A1 | 1/2008 | Yan |
| 2008/0038257 A1 | 2/2008 | Han et al. |
| 2008/0112888 A1 | 5/2008 | Wang |
| 2008/0118506 A1 | 5/2008 | An et al. |
| 2008/0118978 A1 | 5/2008 | Sato et al. |
| 2008/0171014 A1 | 7/2008 | Wu et al. |

(56) References Cited

U.S. PATENT DOCUMENTS

| | | | |
|---|---|---|---|
| 2008/0175847 A1 | 7/2008 | Yan et al. | |
| 2008/0187966 A1 | 8/2008 | Simmons | |
| 2008/0193455 A1 | 8/2008 | Stassen et al. | |
| 2008/0219971 A1 | 9/2008 | Smith et al. | |
| 2008/0241163 A1 | 10/2008 | Burkly et al. | |
| 2009/0028851 A1 | 1/2009 | Stuhmer et al. | |
| 2009/0030308 A1 | 1/2009 | Bradford et al. | |
| 2009/0035308 A1* | 2/2009 | Gill et al. | 424/133.1 |
| 2009/0042214 A1 | 2/2009 | Cooke et al. | |
| 2009/0048122 A1 | 2/2009 | Glaser et al. | |
| 2009/0053243 A1 | 2/2009 | Kurosawa et al. | |
| 2009/0068195 A1 | 3/2009 | Vugmeyster et al. | |
| 2009/0081234 A1 | 3/2009 | Heavner et al. | |
| 2009/0148513 A1 | 6/2009 | Fraunhofer et al. | |
| 2009/0155257 A1 | 6/2009 | Adams et al. | |
| 2009/0155275 A1 | 6/2009 | Wu et al. | |
| 2009/0191225 A1 | 7/2009 | Chang et al. | |
| 2009/0208490 A1 | 8/2009 | Pavone et al. | |
| 2009/0215992 A1 | 8/2009 | Wu et al. | |
| 2009/0259026 A1 | 10/2009 | Tomlinson et al. | |
| 2009/0304693 A1 | 12/2009 | Ghayur et al. | |
| 2009/0311253 A1 | 12/2009 | Ghayur et al. | |
| 2010/0028340 A1 | 2/2010 | Mueller et al. | |
| 2010/0040537 A1 | 2/2010 | Gu et al. | |
| 2010/0047239 A1 | 2/2010 | Wu et al. | |
| 2010/0056762 A1 | 3/2010 | Old | |
| 2010/0074900 A1 | 3/2010 | Ghayur et al. | |
| 2010/0104573 A1 | 4/2010 | Burkly et al. | |
| 2010/0105569 A1 | 4/2010 | Hsieh et al. | |
| 2010/0158901 A1 | 6/2010 | Tedder et al. | |
| 2010/0190247 A1 | 7/2010 | Lazar et al. | |
| 2010/0233079 A1 | 9/2010 | Jakob et al. | |
| 2010/0266531 A1 | 10/2010 | Hsieh et al. | |
| 2011/0008766 A1 | 1/2011 | Ghayur et al. | |
| 2011/0044980 A1 | 2/2011 | Ghayur et al. | |
| 2011/0091372 A1 | 4/2011 | Ghayur et al. | |
| 2011/0091463 A1 | 4/2011 | Ghayur et al. | |
| 2011/0117079 A1 | 5/2011 | Benatuil et al. | |
| 2011/0142761 A1 | 6/2011 | Wu et al. | |
| 2011/0150870 A1 | 6/2011 | Rader et al. | |
| 2011/0212094 A1 | 9/2011 | Ghayur et al. | |
| 2011/0217237 A1 | 9/2011 | Chen et al. | |
| 2011/0229476 A1 | 9/2011 | Liu et al. | |
| 2011/0263827 A1 | 10/2011 | Ghayur et al. | |
| 2011/0318349 A1 | 12/2011 | Ghayur et al. | |
| 2012/0014957 A1 | 1/2012 | Ghayur et al. | |
| 2012/0034160 A1 | 2/2012 | Ghayur et al. | |
| 2012/0087858 A1 | 4/2012 | Ghayur et al. | |
| 2012/0258108 A1 | 10/2012 | Ghayur et al. | |
| 2012/0263722 A1 | 10/2012 | Ghayur et al. | |
| 2013/0004416 A1 | 1/2013 | Wu et al. | |
| 2013/0171059 A1 | 7/2013 | Ghayur et al. | |
| 2013/0171096 A1 | 7/2013 | Hsieh et al. | |
| 2013/0195871 A1 | 8/2013 | Ghayur et al. | |
| 2013/0236458 A1 | 9/2013 | Hsieh et al. | |

FOREIGN PATENT DOCUMENTS

| | | |
|---|---|---|
| EP | 0 517 024 A2 | 12/1992 |
| EP | 0 592 106 A1 | 4/1994 |
| EP | 0 239 400 B1 | 8/1994 |
| EP | 1 176 195 A1 | 1/2002 |
| EP | 1 454 917 A2 | 9/2004 |
| EP | 0 592 106 B1 | 11/2004 |
| EP | 0 519 596 B1 | 2/2005 |
| RU | 2 273 664 C2 | 4/2006 |
| WO | WO 89/06692 A1 | 7/1989 |
| WO | WO 90/02809 A1 | 3/1990 |
| WO | WO 90/05144 A1 | 5/1990 |
| WO | WO 90/05183 A1 | 5/1990 |
| WO | WO 90/14424 A1 | 11/1990 |
| WO | WO 90/14430 A1 | 11/1990 |
| WO | WO 90/14443 A1 | 11/1990 |
| WO | WO 91/05548 A1 | 5/1991 |
| WO | WO 91/09967 A1 | 7/1991 |
| WO | WO 91/10737 A1 | 7/1991 |
| WO | WO 91/10741 A1 | 7/1991 |
| WO | WO 91/17271 A1 | 11/1991 |
| WO | WO 91/18983 A1 | 12/1991 |
| WO | WO 92/01047 A1 | 1/1992 |
| WO | WO 92/02551 A1 | 2/1992 |
| WO | WO 92/03461 A1 | 3/1992 |
| WO | WO 92/09690 | 6/1992 |
| WO | WO 92/09690 A2 | 6/1992 |
| WO | WO 92/11272 A1 | 7/1992 |
| WO | WO 92/15679 A1 | 9/1992 |
| WO | WO 92/16553 A1 | 10/1992 |
| WO | WO 92/18619 A1 | 10/1992 |
| WO | WO 92/19244 A2 | 11/1992 |
| WO | WO 92/20791 A1 | 11/1992 |
| WO | WO 92/22324 A1 | 12/1992 |
| WO | WO 92/22653 A1 | 12/1992 |
| WO | WO 93/01288 A1 | 1/1993 |
| WO | WO 93/06213 A1 | 4/1993 |
| WO | WO 93/11161 A1 | 6/1993 |
| WO | WO 93/11236 A1 | 6/1993 |
| WO | WO 94/02602 A1 | 2/1994 |
| WO | WO 94/11026 A2 | 5/1994 |
| WO | WO 94/18219 A1 | 8/1994 |
| WO | WO 95/01997 A1 | 1/1995 |
| WO | WO 95/09917 A1 | 4/1995 |
| WO | WO 95/14780 A2 | 6/1995 |
| WO | WO 95/15982 A2 | 6/1995 |
| WO | WO 95/20045 A1 | 7/1995 |
| WO | WO 95/20401 A1 | 8/1995 |
| WO | WO 95/24918 A1 | 9/1995 |
| WO | WO 95/25167 A1 | 9/1995 |
| WO | WO 96/20698 A2 | 7/1996 |
| WO | WO 96/33735 A1 | 10/1996 |
| WO | WO 96/34096 A1 | 10/1996 |
| WO | WO 96/40210 A1 | 12/1996 |
| WO | WO 97/20032 A1 | 6/1997 |
| WO | WO 97/29131 A1 | 8/1997 |
| WO | WO 97/32572 A2 | 9/1997 |
| WO | WO 97/44013 A1 | 11/1997 |
| WO | WO 98/16654 A1 | 4/1998 |
| WO | WO 98/24893 A2 | 6/1998 |
| WO | WO 98/31346 A1 | 7/1998 |
| WO | WO 98/31700 A1 | 7/1998 |
| WO | WO 98/45331 A2 | 10/1998 |
| WO | WO 98/50433 A2 | 11/1998 |
| WO | WO 99/06834 A2 | 2/1999 |
| WO | WO 99/15154 A1 | 4/1999 |
| WO | WO 99/20253 A1 | 4/1999 |
| WO | WO 99/23221 A2 | 5/1999 |
| WO | WO 99/45031 A2 | 9/1999 |
| WO | WO 99/53049 A1 | 10/1999 |
| WO | WO 99/54342 A1 | 10/1999 |
| WO | WO 99/57134 | 11/1999 |
| WO | WO 99/66903 A2 | 12/1999 |
| WO | WO 00/09560 A2 | 2/2000 |
| WO | WO 00/37504 A2 | 6/2000 |
| WO | WO 00/56772 A1 | 9/2000 |
| WO | WO 00/78815 A1 | 12/2000 |
| WO | WO 01/00244 A2 | 1/2001 |
| WO | WO 01/32712 A2 | 5/2001 |
| WO | WO 01/58956 A2 | 8/2001 |
| WO | WO 01/62300 A2 | 8/2001 |
| WO | WO 01/62931 A2 | 8/2001 |
| WO | WO 01/71005 A2 | 9/2001 |
| WO | WO 01/77342 A1 | 10/2001 |
| WO | WO 01/83525 A2 | 11/2001 |
| WO | WO 01/88138 A1 | 11/2001 |
| WO | WO 02/02773 A2 | 1/2002 |
| WO | WO 02/02781 A1 | 1/2002 |
| WO | WO 02/16436 A2 | 2/2002 |
| WO | WO 02/053596 A2 | 7/2002 |
| WO | WO 02/072636 A2 | 9/2002 |
| WO | WO 02/097048 A2 | 12/2002 |
| WO | WO 03/016466 A2 | 2/2003 |
| WO | WO 03/035835 A2 | 5/2003 |
| WO | WO 03/039486 | 5/2003 |
| WO | WO 03/068801 A2 | 8/2003 |

(56) References Cited

FOREIGN PATENT DOCUMENTS

| | | |
|---|---|---|
| WO | WO 03/086458 A1 | 10/2003 |
| WO | WO 03/089614 A2 | 10/2003 |
| WO | WO 03/100008 A2 | 12/2003 |
| WO | WO 03/102132 A2 | 12/2003 |
| WO | WO 2004/016286 A2 | 2/2004 |
| WO | WO 2004/024866 A2 | 3/2004 |
| WO | WO 2004/050683 A2 | 6/2004 |
| WO | WO 2004/058184 A2 | 7/2004 |
| WO | WO 2004/078140 A2 | 9/2004 |
| WO | WO 2005/016970 | 2/2005 |
| WO | WO 2005/017107 | 2/2005 |
| WO | WO 2005/044853 A2 | 5/2005 |
| WO | WO 2005/061540 A2 | 7/2005 |
| WO | WO 2005/061547 A2 | 7/2005 |
| WO | WO 2005/100584 A2 | 10/2005 |
| WO | WO 2005/120557 A2 | 12/2005 |
| WO | WO 2006/013107 A1 | 2/2006 |
| WO | WO 2006/015373 A2 | 2/2006 |
| WO | WO 2006/020258 A2 | 2/2006 |
| WO | WO 2006/024867 A2 | 3/2006 |
| WO | WO 2006/031370 A2 | 3/2006 |
| WO | WO 2006/044908 A2 | 4/2006 |
| WO | WO 2006/047350 A2 | 5/2006 |
| WO | WO 2006/066171 A1 | 6/2006 |
| WO | WO 2006/089133 A2 | 8/2006 |
| WO | WO 2006/099398 A2 | 9/2006 |
| WO | WO 2006/099698 A2 | 9/2006 |
| WO | WO 2006/110883 A2 | 10/2006 |
| WO | WO 2006/116269 A2 | 11/2006 |
| WO | WO 2006/122187 A2 | 11/2006 |
| WO | WO 2006/130374 A2 | 12/2006 |
| WO | WO 2006/130429 A2 | 12/2006 |
| WO | WO 2006/131951 A2 | 12/2006 |
| WO | WO 2006/136159 A2 | 12/2006 |
| WO | WO 2007/005955 A2 | 1/2007 |
| WO | WO 2007/024715 A9 | 3/2007 |
| WO | WO 2007/042261 A2 | 4/2007 |
| WO | WO 2007/048849 A1 | 5/2007 |
| WO | WO 2007/053447 A2 | 5/2007 |
| WO | WO 2007/056470 A2 | 5/2007 |
| WO | WO 2007/059136 A2 | 5/2007 |
| WO | WO 2007/062037 A2 | 5/2007 |
| WO | WO 2007/062852 A2 | 6/2007 |
| WO | WO 2007/077028 A2 | 7/2007 |
| WO | WO 2007/117749 A2 | 10/2007 |
| WO | WO 2007/120651 A2 | 10/2007 |
| WO | WO 2007/120828 A1 | 10/2007 |
| WO | WO 2007/124299 A2 | 11/2007 |
| WO | WO 2007/143098 A2 | 12/2007 |
| WO | WO 2007/147901 A1 | 12/2007 |
| WO | WO 2008/011348 A2 | 1/2008 |
| WO | WO 2008/022152 A2 | 2/2008 |
| WO | WO 2008/024188 A2 | 2/2008 |
| WO | WO 2008/042236 A2 | 4/2008 |
| WO | WO 2008/057240 A2 | 5/2008 |
| WO | WO 2008/079326 A2 | 7/2008 |
| WO | WO 2008/100624 A2 | 8/2008 |
| WO | WO 2008/145338 A2 | 12/2008 |
| WO | WO 2008/150841 A1 | 12/2008 |
| WO | WO 2009/020654 A1 | 2/2009 |
| WO | WO 2009/052400 A1 | 4/2009 |
| WO | WO 2009/077993 A2 | 6/2009 |
| WO | WO 2009/089004 A1 | 7/2009 |
| WO | WO 2009/136382 A2 | 11/2009 |
| WO | WO 2009/155324 A2 | 12/2009 |
| WO | WO 2010/006060 A2 | 1/2010 |
| WO | WO 2010/096434 A2 | 8/2010 |
| WO | WO 2010/102251 A2 | 9/2010 |
| WO | WO 2011/039370 A1 | 4/2011 |
| WO | WO 2011/084714 A2 | 7/2011 |
| WO | WO 2012/061374 A2 | 5/2012 |

OTHER PUBLICATIONS

Azzazy et al., "Phage display technology: clinical applications and recent innovations," *Clin. Biochem.*, 35: 425-445 (2002).

Babcook et al., "A novel strategy for generating monoclonal antibodies from single, isolated lymphocytes producing antibodies of defined specificities," *Proc. Natl. Acad. Sci. USA*, 93: 7843-7848 (1996).

Bäckström et al., "Signaling Efficiency of the T Cell Receptor Controlled by a Single Amino Acid in the β Chain Constant Region," *J. Exp. Med.*, 186(11): 1933-1938 (1997).

Barbas et al., "Assembly of combinatorial antibody libraries on phage surfaces: The gene III site," *Proc. Natl. Acad. Sci. USA*, 88: 7978-7982 (1991).

Barbas et al., "In vitro evolution of a neutralizing human antibody to human immunodeficiency virus type 1 to enhance affinity and broaden strain cross-reactivity," *Proc. Natl. Acad. Sci. USA*, 91: 3809-3813 (1994).

Baslund et al., "Targeting interleukin-15 in patients with rheumatoid arthritis," *Arthritis Rheum.*, 52(9): 2686-2692 (2005).

Baumgartner et al., "Double blind, placebo controlled trial of tumor necrosis factor receptor fusion protein (TNFR:Fc) in active rheumatoid arthritis," Biomedicine '96. Medical Research from Bench to Bedside. Washington, DC, May 3-6, 1996. *J. Invest. Med.*, 44(3):235A (Mar. 1996) (Abstract).

Bessis et al., "Use of hollow fibers filled with cells engineered to secrete IL-4 or IL-13 for treatment of experimental arthritis," (Abstract No. 1681), *Arthritis Rheum.*, 39(9Suppl.): S308 (1996).

Better et al., "*Escherichia coli* Secretion of an Active Chimeric Antibody Fragment," *Science*, 240: 1041-1043 (1988).

Biewenga et al., "IgA1 half molecules in human multiple myeloma and the in vitro production of similar fragments from intact IgA1 molecules," *Clin. Exp. Immunol.*, 51: 395-400 (1983).

Bird et al., "Single-Chain Antigen-Binding Proteins," *Science*, 242: 423-426 (1988).

Bornemann et al., "Aβ-Induced Inflammatory Processes in Microglia Cells of APP23 Transgenic Mice," *Am. J. Pathol.*, 158(1): 63-73 (2001).

Boyce et al., "No audible wheezing: nuggets and conundrums from mouse asthma models," *J. Exp. Med.*, 201(12): 1869-1873 (2005).

Brand, D.D., "Rodent Models of Rheumatoid Arthritis," *Comparative Medicine*, 55(2): 114-122 (2005).

Bree et al., "IL-13 blockade reduces lung inflammation after *Ascaris suum* challenge in cynomolgus monkeys," *J. Allergy Clin. Immunol.*, 119(5): 1251-1257 (2007).

Brennan et al., "Preparation of Bispecific Antibodies by Chemical Recombination of Monoclonal Immunoglobulin $G_1$ Fragments," *Science*, 229: 81-83 (1985).

Brinkmann et al., "Phage display of disulfide-stabilized Fv fragments," *J. Immunol. Methods*, 182: 41-50 (1995).

Brüsselbach et al., "Enzyme recruitment and tumor cell killing in vitro by a secreted bispecific single-chain diabody," *Tumor Targeting*, 4: 115-123 (1999).

Bruncko et al., "Studies leading to potent, dual inhibitors of Bcl-2 and Bcl-xL," *J. Med. Chem.*, 50(4): 641-662 (2007).

Buchwald et al., "Long-term, continuous intravenous heparin administration by an implantable infusion pump in ambulatory patients with recurrent venous thrombosis," *Surgery*, 88: 507-516 (1980).

Buras et al., "Animal Models of Sepsis: Setting the Stage," *Nat. Rev. Drug. Discovery*, 4: 854-865 (2005).

Burke et al., "Zotarolimus (ABT-578) eluting stents," *Adv. Drug Del. Rev.*, 58: 437-446 (2006).

Burton et al., "Human Antibodies from Combinatorial Libraries," *Adv. Immunol.*, 57: 191-280 (1994).

Calandra et al., "Protection from septic shock by neutralization of macrophage migration inhibitory factor," *Nature Med.*, 6(2): 164-170 (2000).

Carroll et al., "The selection of high-producing cell lines using flow cytometry and cell sorting," *Expert Opin. Biol. Ther.*, 4: 1821-1829 (2004).

Carter et al., "Humanization of an anti-p185$^{HER2}$ antibody for human cancer therapy," *Proc. Natl. Acad. Sci. USA*, 89: 4285-4289 (1992).

Chikanza et al., "Treatment of patients with rheumatoid arthritis with RP73401 phosphodiesterase Type IV inhibitor," Abstract No. 1527), *Arthritis Rheum.*, 39(9 Suppl.): S282 (1996).

(56) References Cited

OTHER PUBLICATIONS

Choi et al., "Recombinant chimeric OKT3 scFv IgM antibodies mediate immune suppression while reducing T cell activation in vitro," *Eur. J. Immunol.*, 31(1): 94-106 (2001).

Chothia et al., "Canonical Structures for the Hypervariable Regions of Immunoglobulins," *J. Mol. Biol.*, 196: 901-917 (1987).

Chothia et al., "Conformations of immunoglobulin hypervariable regions," *Nature*, 342: 877-883 (1989).

Clackson et al., "Making antibody fragments using phage display libraries," *Nature*, 352: 624-628 (1991).

Cleek et al., "Biodegradable Polymeric Carriers for a bFGF Antibody for Cardiovascular Application," *Proceed. Intl. Symp. Control. Rel. Bioact. Mater.*, 24: 853-854 (1997).

Co et al., "Genetically Engineered Deglycosylation of the Variable Domain Increases the Affinity of an Anti-CD33 Monoclonal Antibody," *Mol. Immunol.*, 30(15): 1361-1367 (1993).

Coffman et al., "Nonhuman primate models of asthma," *J. Exp. Med.*, 201(12): 1875-1879 (2005).

Coloma et al., "Design and production of novel tetravalent bispecific antibodies," *Nature Biotechnol.*, 15: 159-163 (1997).

Cox et al., "Measurement of cytokine release at the single cell level using the ELISPOT assay," *Methods*, 38(4): 274-282 (2006).

Dall'Acqua et al., "Contribution of Domain Interface Residues to the Stability of Antibody $C_H3$ Domain Homodimers," *Biochemistry*, 37: 9266-9273 (1998).

Dall'Acqua et al., "Increasing the affinity of a human IgG1 for the neonatal Fc receptor: biological consequences," *J. Immunol.*, 169(9): 5171-5180 (2002).

Dall'Acqua et al., "Properties of human IgG1s engineered for enhanced binding to the neonatal Fc receptor (FcRn)," *J. Biol. Chem.*, 281: 23514-23524 (2006).

D'Andrea et al., "Production of Natural Killer Cell Stimulatory Factor (Interleukin 12) by Peripheral Blood Mononuclear Cells," *J. Exp. Med.*, 176: 1387-1398 (1992).

Deane et al., "RAGE mediates amyloid-β peptide transport across the blood-brain barrier and accumulation in brain," *Nature Med.*, 9(7): 907-913 (2003).

Deluca et al., "Marine and botanical lipids as immunomodulatory and therapeutic agents in the treatment of rheumatoid arthritis," *Rheum. Dis. Clin. North Am.*, 21: 759-777 (1995).

Descotes, J., "Immunotoxicology of Immunomodulators," *Develop. Biol. Standard*, 77: 99-102 (1992).

Desmet et al., "Anchor profiles of HLA-specific peptides: analysis by a novel affinity scoring method and experimental validation," *Proteins*, 58: 53-69 (2005).

Dickson, B.J., "Molecular Mechanisms of Axon Guidance," *Science*, 298: 1959-1964 (2002).

Dinarello et al., "Measurement of soluble and membrane-bound interleukin 1 using a fibroblast bioassay," Unit 6.2, In *Current Protocols in Immunology*, pp. 6.21-6.27 (2000).

Domeniconi et al., "Overcoming inhibitors in myelin to promote axonal regeneration," *J. Neurological Sciences*, 233: 43-47 (2005).

During et al., "Controlled Release of Dopamine from a Polymeric Brain Implant: In Vivo Characterization," *Ann. Neurol.*, 25(4): 351-356 (1989).

Durocher et al., "High-level and high-throughput recombinant protein production by transient transfection of suspension-growing human 293-EBNA1 cells," *Nucl. Acids Res.*, 30(2): e9, (9 pages) (2002).

Economides et al., "Cytokine traps: multi-component, high-affinity blockers of cytokine action," *Nature Med.*, 9(1): 47-52 (2003).

Enrich et al., "Demonstration of selective COX-2 inhibition by MK-966 in humans," (Abstract No. 328), *Arthritis Rheum.*, 39(9 Suppl.): S81 (1996).

Enrich et al., "Efficacy of MK-966, a highly selective inhibitor of COX-2, in the treatment of postoperative dental pain," (Abstract No. 329), *Arthritis Rheum.*, 39(9Suppl.): S81 (1996).

Evans et al., "Efficacy of tumor necrosis factor binding protein (TNF-bp) in the streptococcal cell wall-induced reactivation model of arthritis," (Abstract No. 1540), *Arthritis Rheum.*, 39(9 Suppl.): S284 (1996).

Farr et al., "Sulphasalazine (SASP) in rheumatoid arthritis (RA): A 5 year prospective study," (Abstract No. 1519), *Arthritis Rheum.*, 39(9 Suppl.): S281 (1996).

Fiebich et al., "Effects of NSAIDs on IL-1-beta-induced IL-6 mRNA and protein synthesis in human astrocytoma cells," *NeuroReport*,7: 1209-1213 (1996).

Finnegan et al., "Leflunomide inhibits immunoglobulin production by two separate mechanisms," (Abstract No. 627), *Arthritis Rheum.*, 39(9 (Suppl.): S131 (1996).

Finotto, et al., "Asthmatic changes in mice lacking T-bet are mediated by IL-13," *Int. Immunol.*, 17(8): 993-1007 (2005).

Fuchs et al., "Targeting Recombinant Antibodies to the Surface of *Escherichia coli*: Fusion to a Peptidoglycan Associated Lipoprotein," *Bio/Technology*, 9: 1369-1372 (1991).

Garrard et al., "$F_{AB}$ Assembly and Enrichment in a Monovalent Phage Display System," *Bio/Technology*, 9: 1373-1377 (1991).

Gavilondo et al., "Antibody Engineering at the Millennium," *Biotechniques*, 29: 128-145 (2000).

Genain et al., "Creation of a model for multiple sclerosis in *Callithrix jacchus* marmosets," *J. Mol. Med.*, 75(3): 187-197 (1997).

Genovese et al., "Abatacept for Rheumatoid Arthritis Refractory to Tumor Necrosis Factor α Inhibition," *N. Engl. J. Med.*, 353: 1114-1123 (2005).

Ghetie et al., "Increasing the serum persistence of an IgG fragment by random mutagenesis," *Nature Biotechnol.*, 15(7): 637-640 (1997).

Giegé et al., Chapter 1, In *Crystallization of Nucleic Acids and Proteins, a Practical Approach*, 2nd ed., (Ducruix and Giegé, eds.) (Oxford University Press, New York, 1999) pp. 1-16.

Glennie et al., "Preparation and Performance of Bispecific $F(ab'\gamma)_2$ Antibody Containing Thioether-Linked Fab'γ Fragments," *J. Immunol.*, 139(7): 2367-2375 (1987).

Goldspiel et al., "Human Gene Therapy," *Clin. Pharm.*, 12: 488-505 (1993).

Goodson, J.M., "Dental Applications," Chapter 6, In *Medical Applications of Controlled Release, vol. II, Applications and Evaluation*, (Langer and Wise, eds.) (CRC Press, Inc., Boca Raton, 1984), pp. 115-138.

Gracie et al., "A proinflammatory role for IL-18 in rheumatoid arthritis," *J. Clin. Invest.*, 104(10): 1393-1401 (1999).

Gram et al., "In vitro selection and affinity maturation of antibodies from a naive combinatorial immunoglobulin library," *Proc. Natl. Acad. Sci. USA*, 89: 3576-3580 (1992).

Green et al., "Antigen-specific human monoclonal antibodies from mice engineered with human Ig heavy and light chain YACs," *Nature Genetics*, 7: 13-21 (1994).

Green et al., "Regulation of B Cell Development by Variable Gene Complexity in Mice Reconstituted with Human Immunoglobulin Yeast Artificial Chromosomes," *J. Exp. Med.*, 188(3): 483-495 (1998).

Griffin et al., "Blockade of T Cell Activation Using a Surface-Linked Single Chain Antibody to CTLA-4 (CD152)," *J. Immunol.*, 164: 4433-4442 (2000).

Griffiths et al., "Human anti-self antibodies with high specificity from phage display libraries," *EMBO J.*, 12(2): 725-734 (1993).

Guttadauria, M., "Tenidap in Rheumatoid Arthritis Collaborative International Study (TRACIS): a 6-month interim analysis," (Abstract No. 1516), *Arthritis Rheum.*, 39(9 Suppl.): S280 (1996).

Hammerling et al., eds., "Appendix: Production of Antibody-Producing Hybridomas in the Rodent Systems," In *Monoclonal Antibodies and T-Cell Hybridomas,Research Monographs In Immunology*, vol. 3 (J.L. Turk, General Editor) (Elsevier, New York, 1981), pp. 563-587.

Hanasaki et al., "Binding of Human Plasma Sialoglycoproteins by the B Cell-specific Lectin CD22," *J. Biol. Chem.*, 270(13): 7543-7550 (1995).

Hara et al., "Therapeutic effect of T-614, a new anti-arthritic agent, on rheumatoid arthritis," (Abstract No. 1526), *Arthritis Rheum.*, 39(9 Suppl.): S282 (1996).

(56) References Cited

OTHER PUBLICATIONS

Harriman et al., "Summary of clinical trials in rheumatoid arthritis using infliximab, an anti-TNFα treatment," *Ann. Rheum. Dis.*, 58(Suppl. I): I61-I64 (1999).
Hart et al., "Preclinical efficacy and safety of mepolizumab (SB-240563), a humanized monoclonal antibody to IL-5, in cynomolgus monkeys," *J. Allergy Clin. Immunol.*, 108(2): 250-257 (2001).
Hawkins et al., "Selection of Phage Antibodies by Binding Affinity Mimicking Affinity Maturation," *J. Mol. Biol.*, 226: 889-896 (1992).
Hay et al., "Bacteriophage cloning and *Escherichia coli* expression of a human IgM Fab," *Hum. Antibod. Hybridomas*, 3: 81-85 (1992).
Hickey et al., "The Rheumatoid Arthritis Azathioprine Registry (RAAR)—interim analysis of malignancy and mortality," (Abstract No. 1521), *Arthritis Rheum.*, 39(9 Suppl.): S281 (1996).
Hildebrand et al., "Surface coatings for biological activation and functionalization of medical devices," *Surface & Coatings Technology*, 200: 6318-6324 (2006).
Hinton et al., "Engineered human IgG antibodies with longer serum half-lives in primates," *J. Biol. Chem.* 279(8): 6213-6216 (2004).
Holliger et al., "'Diabodies': Small bivalent and bispecific antibody fragments," *Proc. Natl. Acad. Sci. USA*, 90: 6444-6448 (1993).
Holliger et al., "Diabodies: small bispecific antibody fragments," *Cancer Immunol. Immunother.*, 45: 128-130 (1997).
Hoogenboom et al., "Multi-subunit proteins on the surface of filamentous phage: methodologies for displaying antibody (Fab) heavy and light chains," *Nucl. Acids Res.*, 19(15): 4133-4137 (1991).
Hoogenboom et al., "Natural and designer binding sites made by phage display technology," *Immunol. Today*, 21(8): 371-378 (2000).
Hoogenboom, H.R., "Designing and optimizing library selection strategies for generating high-affinity antibodies," *Trends Biotechnol.*, 15: 62-70 (1997).
Hoogenboom, H.R., "Mix and match: Building manifold binding sites," *Nature Biotechnol.*, 15: 125-126 (1997).
Howard et al., "Intracerebral drug delivery in rats with lesion-induced memory deficits," *J. Neurosurg.*, 71: 105-112 (1989).
Huber et al., "Crystallographic structure studies of an IgG molecule and an Fc fragment," *Nature*, 264: 415-420 (1976).
Huse et al., "Generation of a Large Combinatorial Library of the Immunoglobulin Repertoire in Phage Lambda," *Science*, 246: 1275-1281 (1989).
Huston et al., "Protein engineering of antibody binding sites: Recovery of specific activity in an anti-digoxin single-chain Fv analogue produced in *Escherichia coli*," *Proc. Natl. Acad. Sci. USA*, 85: 5879-5883 (1988).
Huston et al., "Protein Engineering of Single-Chain Fv Analogs and Fusion Proteins," *Methods Enzymol.*, 203: 46-88 (1991).
Hwang et al., "Cutting Edge: Targeted Ligation of CTLA-4 In Vivo by Membrane-Bound Anti-CTLA-4 Antibody Prevents Rejection of Allogeneic Cells," *J. Immunol.*, 163: 633-637 (2002).
Ito et al., "Transfer of Severe Experimental Autoimmune Encephalomyelitis by IL-12- and IL-18-Potentiated T Cells is Estrogen Sensitive," *J. Immunol.*, 170(9): 4802-4809 (2003).
Jackson et al., "In Vitro Antibody Maturation, Improvement of a High Affinity, Neutralizing Antibody Against IL-1β," *J. Immunol.*, 154(7): 3310-3319 (1995).
Janelsins et al., "Early correlation of microglial activation with enhanced tumor necrosis factor-alpha and monocyte chemoattractant protein-I expression specifically within the entorhinal cortex of triple transgenic Alzheimer's disease mice," *J. Neuroinflammation*, 2(23): 1-12 (2005).
Jefferis, R., "Glycosylation of Recombinant Antibody Therapuetics," *Biotechnol. Prog.*, 21: 11-16 (2005).
Jiang et al., "Regulation of recombinant monoclonal antibody production in Chinese hamster ovary cells: a comparative study of gene copy number, mRNA level, and protein expression," *Biotechnol. Prog.*, 22(1): 313-318 (2006).
Johnsson et al., "Immobilization of Proteins to a Carboxymethyldextran-Modified Gold Surface for Biospecific Interaction Analysis in Surface Plasmon Resonance Sensors," *Anal. Biochem.*, 198: 268-277 (1991).
Johnsson et al., "Comparison of Methods for Immobilization to Carboxymethyl Dextran Sensor Surfaces by Analysis of the Specific Activity of Monoclonal Antibodies," *J. Mol. Recognit.*, 8: 125-131 (1995).
Joliot et al., "Antennapedia homeobox peptide regulates neural morphogenesis," *Proc. Natl. Acad. Sci. USA*, 88: 1864-1868 (1991).
Jones, A.G., "Particle formation and separation in suspension crystallization processes," Chapter 4, In *Process. Solid-Liq. Suspensions*, (P. Ayazi Shamlou, ed.) (Butterworth-Heinemann, Oxford, UK, 1993) pp. 93-117.
Jones, A.J.S., "Analytical methods for the assessment of protein formulations and delivery systems," Chapter 2, In *Formulation and Delivery of Proteins and Peptides*, 1st ed., (Cleland and Langer, eds.) (American Chemical Society, Washington, D.C., 1994) pp. 22-45.
Jones et al., "Replacing the complementarity-determining regions in a human antibody with those from a mouse," *Nature*, 321: 522-525 (1986).
Jones, R., "Rovelizumab—ICOS Corp," *IDrugs*, 3(4): 442-446 (2000).
Jönsson, et al., "Real-Time Biospecific Interaction Analysis Using Surface Plasmon Resonance and a Sensor Chip Technology," *BioTechniques*, 11(5): 620-627 (1991).
Jönsson et al., "Introducing a biosensor based technology for real-time biospecific interaction analysis," *Ann. Biol. Clin.*, 51: 19-26 (1993).
Joosten et al., "Anticytokine Treatment of Established Type II Collagen-Induced Arthritis in DBA/1 Mice," *Arthritis Rheum.*, 39(5): 797-809 (1996).
Jungbluth et al., "A monoclonal antibody recognizing human cancers with amplification/overexpression of the human epidermal growth factor receptor," *Proc. Natl. Acad. Sci. USA*, 100(2): 639-644 (2003).
Kabat et al., "Attempts to Locate Complementarity-Determining Residues in the Variable Positions of Light and Heavy Chains," *Ann. NY Acad. Sci.*, 190: 382-391 (1971).
Mine et al., "Results of a multi-dose protocol 7002 using an immunomodulating, non-depleting Primatized™ anti-CD4 monoclonal antibody in rheumatoid arthritis (RA)," (Abstract No. 195), *Arthritis Rheum.*, 38: S185 (1995).
Kanda et al., "Establishment of a GDP-mannose 4,6-dehydratase (GMD) knockout host cell line: a new strategy for generating completely non-fucosylated recombinant therapeutics," *J. Biotechnol.*, 130(3): 300-310 (2007).
Kapadia et al., "Soluble TNF binding proteins modulate the negative inotropic properties of TNF-alpha in vitro," *Am. J. Physiol. Heart Circ. Physiol.* 268 (2 Pt. 2): H517-H525 (1995).
Karnezis et al., "The neurite outgrowth inhibitor Nogo A is involved in autoimmune-mediated demyelination," *Nature Neurosci.*, 7: 736-744 (2004).
Karni et al., IL-18 is linked to raised IFN-γ in multiple sclerosis and is induced by activated CD4$^+$ T cells via CD40-CD40 ligand interactions, *J. Neuroimmunol.*, 125: 134-140 (2002).
Kashmiri et al., "SDR grafting—a new approach to antibody humanization," *Methods*, 36(1): 25-34 (2005).
Kaufman and Sharp, "Amplification and expression of sequences cotransfected with a modular dihydrofolate reductase complementary DNA gene," *J. Mol. Biol.*, 159(4): 601-621 (1982).
Keith Jr., et al., "Recombinant human interleukin eleven decreases arthritis in HLA-B27 transgenic rats," (Abstract No. 1613), *Arthritis Rheum.*, 39(9 Suppl.): S296 (1996).
Kellerman et al., "Antibody discovery: the use of transgenic mice to generate human monoclonal antibodies for therapeutics," *Curr. Opin. Biotechnol.*, 13: 593-597 (2002).
Kettleborough et al., "Humanization of a mouse monoclonal antibody by CDR-grafting: the importance of framework residues on loop conformation," *Protein Eng.*, 4(7): 773-783 (1991).
Kettleborough et al., "Isolation of tumor cell-specific single-chain Fv from immunized mice using phage-antibody libraries and the reconstruction of whole antibodies from these antibody fragments," *Eur. J. Immunol.*, 24: 952-958 (1994).
Kim et al., "Identifying amino acid residues that influence plasma clearance of murine IgG1 fragments by site-directed mutagenesis," *Eur. J. Immunol.*, 24: 542-548 (1994).

(56) References Cited

OTHER PUBLICATIONS

Kipriyanov et al., "Bispecific CD3 × CD19 Diabody for T Cell-Mediated Lysis of Malignant Human B Cells," *Int. J. Cancer*, 77: 763-772 (1998).
Kipriyanov et al., "Generation of recombinant antibodies," *Mol. Biotechnol.*, 12: 173-201 (1999).
Klein, W.L., "Aβ toxicity in Alzheimer's disease: globular oligomers (ADDLs) as new vaccine and drug targets," *Neurochem. Int.*, 41: 345-352 (2002).
Klyubin et al., "Amyloid β protein immunotherapy neutralizes Aβ oligomers that disrupt synaptic plasticity in vivo," *Nature Med.*, 11: 556-561 (2005).
Köhler and Milstein, "Continuous cultures of fused cells secreting antibody of predefined specificity," *Nature*, 256: 495-497 (1975).
Konishi et al., "A simple and sensitive bioassay for the detection of human interleukin-18/ interferon-γ-inducing factor using human myelomonocytic KG-1 cells," *J. Immunol. Methods*, 209: 187-191 (1997).
Kontermann, R.E.: "Recombinant bispecific antibodies for cancer therapy," *Acta Pharmacologica Sinica*, 26(1): 1-9 (2005).
Kostelny et al., "Formation of a Bispecific Antibody by the Use of Leucine Zippers," *J. Immunol.*, 148(5): 1547-1553 (1992).
Kriangkum et al., "Bispecific and bifunctional single chain recombinant antibodies," *Biomol. Eng.*, 18: 31-40 (2001).
Kuby, *Immunology*, 2nd ed., (W.H. Freeman and Company, New York, 1994), p. 115, Fig. 5-6.
Lam et al., "Microencapsulation of Recombinant Humanized Monoclonal Antibody for Local Delivery," *Proceed. Intl Symp. Control Rel. Bioact. Mater.*, 24: 759-760 (1997).
Langer and Peppas, "Chemical and Physical Structure of Polymers as Carriers for Controlled Release of Bioactive Agents: A Review," *J. Macromol. Sci. RMC*, C23(1): 61-126 (1983).
Langer, R., "New Methods of Drug Delivery," *Science*, 249: 1527-1533 (1990).
Laue, T., "Analytical centrifugation: equilibrium approach," In *Current Protocols in Protein Science*, (John Wiley & Sons, Inc., New York, 1999), Supplement 18, Unit 20.3, pp. 20.3.1-20.3.13.
Lee et al., "BiP and immunoglobulin light chain cooperate to control the folding of heavy chain and ensure the fidelity of immunoglobulin assembly," *Mol. Biol. Cell*, 10: 2209-2219 (1999).
Lee et al., "Treatment of rheumatoid arthritis (RA) with thalidomide," (Abstract No. 1524), *Arthritis Rheum.*, 39(9 Suppl.): S282 (1996).
Le Gall et al., "Di-, tri- and tetrameric single chain Fv antibody fragments against human CD19: effect of valency on cell binding," *FEBS Letters*, 453: 164-168 (1999).
Le Gall et al., "Immunosuppressive properties of anti-CD3 single-chain Fv and diabody," *J. Immunol. Methods*, 285: 111-127 (2004).
Legros et al., "Characterization of an anti-*Borrelia burgdorferi* OspA conformational epitope by limited proteolysis of monoclonal antibody-bound antigen and mass spectrometric peptide mapping," *Protein Science*, 9: 1002-1010 (2000).
Leung et al., "Combined Effects of IL-12 and IL-18 on the Induction of Collagen-Induced Arthritis," *J. Immunol.*, 164(12): 6495-6502 (2000).
Levy et al., "Inhibition of Calcification of Bioprosthetic Heart Valves by Local Controlled-Release Diphosphonate," *Science*, 228: 190-192 (1985).
Li et al., "Genetically engineered brain drug delivery vectors: cloning, expression and in vivo application of an anti-transferrin receptor single chain antibody-streptavidin fusion gene and protein," *Protein Eng.*, 12(9): 787-796 (1999).
Li et al., "Structural mutations in the constant region of the T-cell antigen receptor (TCR)β chain and their effect on TCRα and β chain interaction," *Immunology*, 88: 524-530 (1996).
Li et al., "Synergistic effects of IL-12 and IL-18 in skewing tumor-reactive T-cell responses towards a type I pattern," *Cancer Res.*, 65(3): 1063-1070 (2005).
Little et al., "Of mice and men: hybridoma and recombinant antibodies," *Immunol. Today*, 21(8): 364-370 (2000).

Lloyd et al., "Mouse Models of Allergic Airway Disease," *Adv. Immunol.*, 77: 263-295 (2001).
Lotz et al., "IL-17 promotes cartilage degradation," (Abstract No. 559), *Arthritis Rheum.*, 39(9Suppl.): S120 (1996).
Lu et al., "A Fully Human Recombinant IgG-like Bispecific Antibody to Both the Epidermal Growth Factor Receptor and the Insulin-like Growth Factor Receptor for Enhanced Antitumor Activity," *J. Biol. Chem.*, 280 (20): 19665-19672 (2005).
Lu et al., "Di-diabody: a novel tetravalent bispecific antibody molecule by design," *J Immunol. Methods*, 279: 219-232 (2003).
Lu et al., "Simultaneous Blockade of Both the Epidermal Growth Factor Receptor and the Insulin-like Growth Factor Receptor Signaling Pathways in Cancer Cells with a Fully Human Recombinant Bispecific Antibody," *J. Biol. Chem.*, 279(4): 2856-2865 (2004).
Lublin, F.D., "Relapsing Experimental Allergic Encephalomyelitis an Autoimmune Model of Multiple Sclerosis," *Springer Semin. Immunopathol.*, 8: 197-208 (1985).
Lund et al., "Human Fc gamma RI and Fc gamma RII interact with distinct but overlapping sites on human IgG," *J. Immunol.*, 147: 2657-2662 (1991).
Luster et al., "Use of animal studies in risk assessment for immunotoxicology," *Toxicology*, 92(1-3): 229-243 (1994).
MacCallum et al., "Antibody-antigen Interactions: Contact Analysis and Binding Site Topography," *J. Mol. Biol.*, 262: 732-745 (1996).
Mack et al., "A small bispecific antibody construct expressed as a functional single-chain molecule with high tumor cell cytotoxicity," *Proc. Natl. Acad. Sci. USA*, 92: 7021-7025 (1995).
Madhusudan et al., "A phase II study of etanercept (Enbrel), a tumor necrosis factor alpha inhibitor in patients with metastatic breast cancer," *Clin. Cancer Res.*, 10(19): 6528-6534 (2004).
Makwana et al., "Molecular mechanisms in successful peripheral regeneration," *FEBS J.*, 272: 2628-2638 (2005).
Marchalonis et al., "Evolutionary Factors in the Emergence of the Combinatorial Germline Antibody Repertoire," *Adv. Exp. Med. Biol.*, 484: 13-30 (2001).
Margolin et al., "Protein crystals as novel catalytic materials," *Angew. Chem. Int. Ed.*, 40: 2204-2222 (2001).
Marks et al., "By-Passing Immunization: Building High Affinity Human Antibodies by Chain Shuffling," *BioTechnology*, 10: 779-783 (1992).
Marques et al., "Mediation of the Cytokine Network in the Implantation of Orthopedic Devices," Chapter 21, In *Biodegradable Systems in Tissue Engineering and Regenerative Medicine*, (Reis et al., eds.) (CRC Press LLC, Boca Raton, 2005) pp. 377-397.
Marquina et al., "Inhibition of B cell death causes the development of an IgA nephropathy in (New Zealand White × C57BL/6)F1-bcl-2 transgenic mice," *J. Immunol.*, 172(11): 7177-7185 (2004).
Martin, A.C.R., "Protein Sequence and Structure Analysis of Antibody Variable Domains," Chapter 31, In *Antibody Engineering* (Kontermann and Dübel, eds. ), (Springer-Verlag, Berlin, 2001), pp. 422-439.
Marvin and Zhu, "Recombinant approaches to IgG-like bispecific antibodies," *Acta Pharmacologica Sinica*, 26(6): 649-658 (2005).
Masliah et al., "Effects of α-Synuclein Immunization in a Mouse Model of Parkinson's Disease," *Neuron*, 46: 857-868 (2005).
Mateo et al., "Humanization of a mouse monoclonal antibody that blocks the epidermal growth factor receptor: recovery of antagonistic activity," *Immunotechnology*, 3: 71-81 (1997).
McCafferty et al., "Phage antibodies: filamentous phage displaying antibody variable domains," *Nature*, 348: 552-554 (1990).
McDonnell et al., "TNF Antagonism," In *New Drugs for Asthma, Allergy and COPD.Prog Respir Res.*, vol. 31, (Hansel et al., eds.) (Karger, Basel, 2001) pp. 247-250.
McGee et al., "The Nogo-66 receptor: focusing myelin inhibition of axon regeneration," *Trends in Neurosciences*, 26(4): 193-198 (2003).
McIntosh et al., "In Vivo Induction of IL-6 by Administration of Exogenous Cytokines and Detection of De Novo Serum Levels of IL-6 in Tumor-Bearing Mice," *J. Immunol.*, 143(1): 162-167 (1989).
Mendez et al., "Functional transplant of megabase human immunoglobulin loci recapitulates human antibody response in mice," *Nature Genet.*, 15: 146-156 (1997).
Merchant et al., "An efficient route to human bispecific IgG," *Nature Biotechnol.*, 16: 677-681 (1998).

(56) References Cited

OTHER PUBLICATIONS

Milstein et al., "Hybrid hybridomas and their use in immunohistochemistry," *Nature*, 305: 537-540 (1983).
Mizushima et al., "pEF-BOS, a powerful mammalian expression vector," *Nucl. Acids Res.*, 18(17): 5322 (1990).
Modjtahedi et al., "Antitumor Activity of Combinations of Antibodies Directed Against Different Epitopes on the Extracellular Domain of the Human EGF Receptor," *Cell Biophys.*, 22(1-3): 129-146 (1993).
Modjtahedi et al., "Phase I trial and tumour localisation of the anti-EGFR monoclonal antibody 1CR62 in head and neck or lung cancer," *Br. J. Cancer*, 73: 228-235 (1996).
Modjtahedi et al., "Targeting of Cells Expressing Wild-Type EGFR and Type-III Mutant EGFR (EGFRVIII) by Anti-EGFR MAB ICR62: A Two-Pronged Attack for Tumour Therapy," *Int. J. Cancer*, 105: 273-280 (2003).
Modjtahedi et al., "The human EGF receptor as a target for cancer therapy: six new rat mAbs against the receptor on the breast carcinoma MDA-MB 468", *Br. J. Cancer*, 67: 247-253 (1993).
Moreland et al., "Soluble tumor necrosis factor receptors (sTNFR): results of a phase I dose-escalation study in patients with rheumatoid arthritis," (Abstract No. 813), *Arthritis Rheum.*, 37: S295 (1994).
Morgan and Anderson, "Human Gene Therapy," *Ann. Rev. Biochem.*, 62: 191-217 (1993).
Moriuchi et al., "Treatment of established collagen-induced arthritis with PGE1 incorporated in lipid microspheres," (Abstract No. 1528), *Arthritis Rheum.*, 39(9 Suppl.): S282 (1996).
Morrison and Schlom, "Recombinant Chimeric Monoclonal Antibodies," Chapter 1, In *Important Advances in Oncology 1990* (J.B. Lippincott Company, Philadelphia, 1990), pp. 3-18.
Morrison, S., "Two heads are better than one," *Nature Biotech.*, 25(11): 1233-1234 (2007).
Müller et al., "The first constant domain ($C_H 1$ and $C_L$) of an antibody used as heterodimerization domain for bispecific miniantibodies," *FEBS Lett.*, 422: 259-264 (1998).
Mulligan, R.C., "The Basic Science of Gene Therapy," *Science*, 260: 926-932 (1993).
Mullinax et al., "Expression of a Heterodimeric Fab Antibody Protein in One Cloning Step," *BioTechniques*, 12(6): 864-869 (1992).
Murthy et al., "Binding of an Antagonistic Monoclonal Antibody to an Intact and Fragmented EGF-Receptor Polypeptide," *Arch. Biochem. Biophys.*, 252(2): 549-560 (1987).
Nakanishi et al., "Interleukin-18 Regulates Both TH1 and TH2 Responses," *Ann. Rev. Immunol.*, 19: 423-474 (2001).
Nelson, R.B. "The Dualistic Nature of Immune Modulation in Alzheimer's Disease: Lessons from the Transgenic Models," *Curr. Pharm. Des.*, 11: 3335-3352 (2005).
Ning et al., "Intratumoral radioimmunotherapy of a human colon cancer xenograft using a sustained-release gel," *Radiotherapy Oncol.*, 39: 179-189 (1996).
Nishimoto et al., "Treatment of rheumatoid arthritis with humanized anti-interleukin-6 receptor antibody," *Arthritis Rheum.*, 50(6): 1761-1769 (2004).
O'Connor et al., "Requirement of multiple phage displayed peptide libraries for optimal mapping of a conformational antibody epitope on CCR5," *J. Immunol. Methods*, 299: 21-35 (2005).
Okamoto et al., "Rituximab for Rheumatoid Arthritis," *N. Engl. J. Med.*, 351: 1909 (2004).
Owens et al., "The Immunology of Multiple Sclerosis and Its Animal Model, Experimental Allergic Encephalomyelitis," *Neurol. Clin.*, 13(1): 51-73 (1995).
Pack and Plückthun, "Miniantibodies: Use of Amphipathic Helices to Produce Functional, Flexibly Linked Dimeric $F_v$ Fragments with High Avidity in *Escherichia coli*," *Biochemistry*, 31: 1579-1584 (1992).
Padilla et al., "IL-13 Regulates the Immune Response to Inhaled Antigens," *J. Immunol.*, 174(12): 8097-8105 (2005).
Padlan, E.A., "A Possible Procedure for Reducing the Immunogenicity of Antibody Variable Domains While Preserving Their Ligand-Binding Properties," *Mol. Immunol.*, 28(4/5): 489-498 (1991).
Padlan et al., "Identification of specificity-determining residues in antibodies," *FASEB J.*, 9: 133-139 (1995).
Park et al., "Generation and characterization of a novel tetravalent bispecific antibody that binds to hepatitis B virus surface antigens," *Molecular Immunol.*, 37: 1123-1130 (2000).
Pearlman and Nguyen, "Analysis of protein drugs," Chapter 6, In *Peptide and Protein Drug Delivery, Advances in Parenteral Sciences*, vol. 4. 1st ed.(Lee, ed.) (Marcel Dekker, Inc., New York, 1991) pp. 247-301.
Peipp et al., "Bispecific antibodies targeting cancer cells," *Biochem. Soc. Trans.*, 30(4): 507-511 (2002).
Peng et al., "Experimental Use of Murine Lupus Models," *Methods Mol. Med.*, 102: 227-272 (2004).
Persic et al., "An integrated vector system for the eukaryotic expression of antibodies or their fragments after seletion from phage display libraries," *Gene*, 187: 9-18 (1997).
Petkova et al., "Enhanced half-life of genetically engineered human IgG1 antibodies in a humanized FcRn mouse model: potential application in humorally mediated autoimmune disease," *Int. Immunol.*, 18: 1759-1769 (2006).
Petrey et al., "Using multiple structure alignments, fast model building, and energetic analysis in fold recognition and homology modeling," *Proteins*, 53: 430-435 (2003).
Plückthun et al., "New protein engineering approaches to multivalent and bispecific antibody fragments," *Immunotechnology*, 3: 83-105 (1997).
Poljak, R.J., "Production and structure of diabodies," *Structure*, 2: 1121-1123 (1994).
Presta et al., "Humanization of an Antibody Directed Against IgE," *J. Immunol.*, 151(5): 2623-2632 (1993).
Presta, L.G., "Engineering of therapeutic antibodies to minimize immunogenicity and optimize function," *Adv. Drug. Del. Rev.*, 58: 640-656 (2006).
Presta, L.G., "Molecular engineering and design of therapeutic antibodies," *Curr. Opin. Immunol.*, 20: 460-470 (2008).
Presta, L.G., "Selection, design, and engineering of therapeutic antibodies," *J. Allergy Clin. Immunol.*, 116: 731-736 (2005).
Remington: *The Science and Practice of Pharmacy*. $21^{st}$ ed.(Lippincott Williams & Wilkins, Philadelphia, 2005) pp. 745-747, 802-804, 838, 889-890, and 1079-1082.
Ridgway et al., "'Knobs-into-holes' engineering of antibody $C_H 3$ domains for heavy chain heterodimerization," *Protein Eng.*, 9(7): 617-621(1996).
Riechmann et al., "Reshaping human antibodies for therapy," *Nature*, 332: 323-327 (1988).
Roberts et al., "RNA-peptide fusions for the in vitro selection of peptides and proteins," *Proc. Natl. Acad. Sci. USA*, 94: 12297-12302 (1997).
Robinson, C., "Gene therapy—proceeding from laboratory to clinic," *Trends Biotechnol.*, 11(5): 155 (1993).
Rodeck et al., "Interations Between Growth Factor Receptors and Corresponding Monoclonal Antibodies in Human Tumors," *J. Cell Biochem.*, 35: 315-320 (1987).
Roguska et al., "A comparison of two murine monoclonal antibodies humanized by CDR-grafting and variable domain resurfacing," *Protein Eng.*, 9(10): 895-904 (1996).
Roguska et al., "Humanization of murine monoclonal antibodies through variable domain resurfacing," *Proc. Natl. Acad. Sci. USA*, 91: 969-973 (1994).
Ronday et al., "Tranexamic acid (TEA), an inhibitor of plasminogen activation, reduces collagen crosslink excretion in arthritis," (Abstract No. 1541), *Arthritis Rheum.*, 39(9 Suppl.): S284 (1996).
Ross, J.M., "Sulfasalazine (SSZ) toxicity: an assessment of American College of Rheumatology (ACR) monitoring guidelines for SSZ," (Abstract No. 1520), *Arthritis Rheum.*, 39(9 Suppl.): S281 (1996).
Sambrook and Russell (eds.), *Molecular Cloning: A Laboratory Manual*. $3^{rd}$ Ed. (Cold Spring Harbor Laboratory Press, Cold Spring Harbor, NY, 2001) Chapters 1, 8, 15 and 16.
Santos et al., "Generation and Characterization of a Single Gene-encoded Single-Chain-Tetravalent Antitumor Antibody," *Clin. Cancer Res.*, 5 (Suppl.): 3118s-3123s (1999).

(56) References Cited

OTHER PUBLICATIONS

Satoh et al., "Non-fucosylated therapeutic antibodies as next-generation therapeutic antibodies," *Expert Opin. Biol. Ther.*, 6(11): 1161-1173 (2006).
Saudek et al., "A Preliminary Trial of the Programmable Implantable Medication System for Insulin Delivery," *N. Engl. J. Med.*, 321: 574-579 (1989).
Sawai et al., "Direct Production of the Fab Fragment Derived From the Sperm Immobilizing Antibody Using Polymerase Chain Reaction and cDNA Expression Vectors," *Am. J. Reprod. Immunol.*, 34: 26-34 (1995).
Schier et al., "Identification of functional and structural amino-acid residues by parsimonious mutagenesis," *Gene*, 169: 147-155 (1995).
Scholz, P., "Inhibition of the production and effect of TNF-alpha by iloprost: possible impact for treatment of rheumatoid arthritis," (Abstract No. 336), *Arthritis Rheum.*, 39(9 Suppl.): S82 (1996).
Sefton, M.V., "Implantable Pumps," *CRC Crit. Rev. Biomed. Eng.*, 14(3): 201-240 (1987).
Seligman et al., "Immunochemical Study of a Human Myeloma IgG1 Half Molecule," *Ann. Immunol.*, 129 C: 855-870 (1978).
Sewell et al., "$DAB_{486}IL-2$ fusion toxin in refractory rheumatoid arthritis," *Arthritis Rheum.*, 36(9): 1223-1233 (Sep. 1993).
Sfikakis et al., "Rituximab anti-B-cell therapy in systemic lupus erythematosus: pointing to the future," *Curr. Opin. Rheumatol.*, 17: 550-557 (2005).
Shapiro et al., "DNA Target Motifs of Somatic Mutagenesis in Antibody Genes," *Crit. Rev. Immunol.*, 22(3): 183-200 (2002).
Shepherd et al., "Novel 'inflammatory plaque' pathology in presenilin-1 Alzheimer's disease," *Neuropathol. Appl. Neurobiol.*, 31: 503-511 (2005).
Shields et al., "Lack of Fucose on Human IgG1 *N*-Linked Oligosaccharide Improves Binding to Human FcγRIII and Antibody-dependent Cellular Toxicity," *J. Biol. Chem.*, 277(30): 26733-26740 (2002).
Shu et al., "Secretion of a single-gene-encoded immunoglobulin from myeloma cells," *Proc. Natl. Acad. Sci. USA*, 90: 7995-7999 (1993).
Sims et al., "A Humanized CD18 Antibody Can Block Function without Cell Destruction," *J. Immunol.*, 151(4): 2296-2308 (1993).
Skerra et al., "Assembly of a Functional Immunoglobulin $F_v$ Fragment in *Escherichia coli*," *Science*, 240: 1038-1041 (1988).
Smith and Morrison, "Recombinant Polymeric IgG: An Approach to Engineering More Potent Antibodies," *Bio/Technology*, 12: 683-688 (1994).
Snibson et al., "Airway remodelling and inflammation in sheep lungs after chronic airway challenge with house dust mite," *Clin. Exp. Allergy*, 35: 146-152 (2005).
Soloman, B., "Alzheimer's Disease and Immunotherapy," *Curr. Alzheimer. Res.*, 1: 149-163 (2004).
Song et al., "Antibody Mediated Lung Targeting of Long-Circulating Emulsions," *PDA J. Pharm. Sci. Technol.*, 50: 372-377 (1996).
Staerz et al., "Hybrid antibodies can target sites for attack by T cells," *Nature*, 314: 628-631 (1985).
Stamper et al., "Crystal structure of the B7-1/CTLA-4 complex that inhibits human immune responses," *Nature*, 410: 608-611 (2001).
Steinman et al., "Virtues and pitfalls of EAE for the development of therapies for multiple sclerosis," *Trends Immunol.*, 26(11):565-571 (2005).
Stickler et al., "CD4+ T-cell epitope determination using unexposed human donor peripheral blood mononuclear cells," *J. Immunotherapy*, 23: 654-660 (2000).
Stolk et al., "Are severe non-hematologic side-effects on azathioprine treatment caused by altered purine enzyme activities?" (Abstract No. 1522), *Arthritis Rheum.*, 39(9 Suppl.): S281 (1996).
Studnicka et al., "Human-engineered monoclonal antibodies retain full specific binding activity by preserving non-CDR complementarity-modulating residues," *Protein Eng.*, 7(6): 805-814 (1994).
't Hart et al., "Suppression of Ongoing Disease in a Nonhuman Primate Model of Multiple Sclerosis by a Human-Anti-Human IL-12p40 Antibody," *J. Immunol.*, 175(7): 4761-4768 (2005).
Taylor et al., "A transgenic mouse that expresses a diversity of human sequence heavy and light chain immunoglobulins," *Nucl. Acids Res.*, 20: 6287-6295 (1992).
Teng et al., "Nogo Signaling and Non-Physical Injury-Induced Nervous System Pathology," *J. Neuroscience Research*, 79: 273-278 (2005).
Thies et al., "Folding and Association of the Antibody Domain $C_H3$: Prolyl Isomerization Preceeds Dimerization," *J. Mol. Biol.*, 293: 67-79 (1999).
Thoss et al., "Immunomodulation of rat antigen-induced arthritis by leflunomide alone and in combination with cyclosporin A," *Inflamm. Res.*, 45: 103-107 (1996).
Tolstoshev, P., "Gene Therapy, Concepts, Current Trials and Future Directions," *Ann. Rev. Pharmacol. Toxicol.*, 32: 573-596 (1993).
Tuohy et al., "Spontaneous Regression of Primary Autoreactivity during Chronic Progression of Experimental Autoimmune Encephalomyelitis and Multiple Sclerosis," *J. Exp. Med.*, 189(7): 1033-1042 (1999).
Umaña et al., "Engineered glycoforms of an antineuroblastoma IgG1 with optimized antibody-dependent cellular cytotoxic activity," *Nature Biotechnol.*, 17: 176-180 (1999).
Urlaub et al., "Isolation of Chinese hamster cell mutants deficient in dihydrofolate reductase activity," *Proc. Natl. Acad. Sci. USA*, 77: 4216-4220 (1980).
Vaccaro et al., "Divergent activities of an engineered antibody in murine and human systems have implications for therapeutic antibodies," *Proc. Natl. Acad. Sci. USA*, 103: 18709-18714 (2006).
Verhoeyen et al., "Reshaping Human Antibodies: Grafting an Antilysozyme Activity," *Science*, 239: 1534-1536 (1988).
von Mehren et al., "Monoclonal Antibody Therapy for Cancer," *Ann. Rev. Med.*, 54: 343-369 (2003).
Wallick et al., "Glycosylation of a $V_H$ Residue of a Monoclonal Antibody Against $\alpha(1\rightarrow6)$ Dextran Increases Its Affinity for Antigen," *J. Exp. Med.*, 168: 1099-1109 (1988).
Ward et al., "Binding activities of a repertoire of single immunoglobulin variable domains secreted from *Escheria coli*," *Nature*, 341: 544-546 (1989).
West Jr. et al., "Crystal Structure and Immunoglobulin G Binding Properties of the Human Major Histocompatibility Complex-Related Fc Receptor," *Biochemistry*, 39: 9698-9708 (2000).
Wileman et al., "Association between Subunit Ectodomains Promote T Cell Antigen Receptor Assembly and Protect against Degradation in the ER," *J. Cell Biol.*, 122(1): 67-78 (1993).
Wing et al., "Ex-vivo whole blood cultures for predicting cytokine-release syndrome: dependence on target antigen and antibody isotype," *Therapeutic Immunol.*, 2(4): 183-190 (1995).
Wooldridge et al., "Tricks with tetramers: how to get the most from multimeric peptide-MHC," *Immunology* 126: 147-164 (2009).
Wright et al., "Antibody variable region glycosylation: position effects on antigen binding and carbohydrate structure," *EMBO J.*, 10(10): 2717-2723 (1991).
Wu and Wu, "Delivery systems for gene therapy," *Biotherapy*, 3: 87-95 (1991).
Wu and Grainger, "Drug/device combinations for local drug therapies and infection prophylaxis," *Biomaterials*, 27: 2450-2467 (2006).
Wu et al., "IL-18 receptor {beta}-induced changes in the presentation of IL-18 binding sites affect ligand binding and signal transduction," *J. Immunol.*, 170: 5571-5577 (2003).
Wu and Wu, "Receptor-mediated in Vitro Gene Transformation by a Soluble DNA Carrier System," *J. Biol. Chem.*, 262(10): 4429-4432 (1987).
Wu et al., "Simultaneous targeting of multiple disease mediators by a dual-variable-domain immunoglobulin," *Nature Biotechnology* (advance online publication, http://www.nature.com/naturebiotechnology), pp. 1-8 (published online Oct. 14, 2007).
Wu et al., "Simultaneous targeting of multiple disease mediators by a dual-variable-domain immunoglobulin," *Nature Biotechnol.*, 25(11): 1290-1297 (2007).
Wu et al., "Tumor localization of anti-CEA single-chain Fvs: improved targeting by non-covalent dimers," *Immunotechnology*, 2(1): 21-36 (1996).

(56) References Cited

OTHER PUBLICATIONS

Wurm, F.M., "Production of recombinant protein therapeutics in cultivated mammalian cells," *Nature Biotechnol.*, 22(11): 1393-1398 (2004).
Xu et al., "Recombinant DNA vaccine encoding multiple domains related to inhibition of neurite outgrowth: a potential strategy for axonal regeneration," *J. Neurochem.*, 91: 1018-1023 (2004).
Yelton et al., "Affinity Maturation of the BR96 Anti-Carcinoma Antibody by Codon-Based Mutagenesis," *J. Immunol.*, 155: 1994-2004 (1995).
Yonehara et al., "Involvement of apoptosis antigen Fas in clonal deletion of human thymocytes," *Int. Immunol.*, 6(12): 1849-1856 (1994).
Zapata et al., "Engineering linear F(ab')$_2$ fragments for efficient production in *Escherichia coli* and enhanced antiproliferative activity," *Protein Eng.*, 8(10): 1057-1062 (1995).
Zola et al., "CD Molecules 2005: human cell differentiation molecules," *Blood*, 106: 3123-3126 (2005).
Zuo et al., "An efficient route to the production of an IgG-like bispecific antibody," *Protein Eng.*, 13(5): 361-367 (2000).
International Patent Application No. PCT/US2006/032398: International Search Report, dated Aug. 18, 2008.
International Patent Application No. PCT/US2006/032398: Written Opinion, dated Aug. 18, 2008.
International Patent Application No. PCT/US2006/032398: International Preliminary Report on Patentability ("IPRP"), dated Jul. 6, 2010.
International Patent Application No. PCT/US2007/017340: International Search Report, dated Jun. 24, 2008.
International Patent Application No. PCT/US2007/017340: Written Opinion, dated Jun. 24, 2008.
International Patent Application No. PCT/US2007/017340: International Preliminary Report on Patentability ("IPRP"), dated Nov. 14, 2008.
Inter Partes Reexamination (Control No. 95/001,380) of U.S. Patent 7,612,181 (U.S. Appl. No. 11/507,050): Replacement Request, dated Jun. 24, 2010.
Inter Partes Reexamination (Control No. 95/001,380) of U.S. Patent 7,612,181 (U.S. Appl. No. 11/507,050): Order of Grant, issued Sep. 1, 2010.
Inter Partes Reexamination (Control No. 95/001,380) of U.S. Patent 7,612,181 (U.S. Appl. No. 11/507,050): Reexamination Non-Final Office Action, dated Sep. 1, 2010.
Inter Partes Reexamination (Control No. 95/001,380) of U.S. Patent 7,612,181 (U.S. Appl. No. 11/507,050): Response After Non-Final Action—Owner Timely ("Patent Owner's Response Pursuant to 37 CFR § 1.945"), dated Nov. 1, 2010.
Inter Partes Reexamination (Control No. 95/001,380) of U.S. Patent 7,612,181 (U.S. Appl. No. 11/507,050): Third Party Requester Comments After Non-Final Action ("Sanofi's Comments Pursuant to 37 CFR § 1.947"), dated Dec. 1, 2010.
Taiwan Patent Application No. 095130565: Taiwan Patent Office Search Report, dated Apr. 24, 2009.
European Patent Application No. 09759344.6: Supplementary European Search Report and Search Opinion, dated Jun. 13, 2012.
International Patent Application No. PCT/US2011/041633: International Search Report and Written Opinion, dated Mar. 13, 2012.
International Patent Application No. PCT/US2011/043297: International Search Report and Written Opinion, dated Feb. 29, 2012.
International Patent Application No. PCT/US2011/046233: International Search Report and Written Opinion, dated Apr. 3, 2012.
International Patent Application No. PCT/US2011/049147: International Search Report and Written Opinion, dated Mar. 21, 2012.
International Patent Application No. PCT/US2011/058769: International Search Report and Written Opinion, dated Jun. 15, 2012.
"Adalimumab," in *The Merck Index*. 14th Ed., John Wiley & Sons, 2006; pp. 26-27.
"Cetuximab," in *The Merck Index*. 14th Ed., John Wiley & Sons, 2006; p. 335.
"Infliximab," in *The Merck Index*. 14th Ed., John Wiley & Sons, 2006; p. 863.
"Rituximab," in *The Merck Index*. 14th Ed., John Wiley & Sons, 2006; p. 1422.
"Trastuzumab," in *The Merck Index*. 14th Ed., John Wiley & Sons, 2006; p. 1646.
Andrew et al., "Fragmentation of Immunoglobulin G," *Current Protocols in Cell Biology*, 16.4.1-16.4.10 (2000).
Andrew et al., "Fragmentation of Immunoglobulin G," *Current Protocols in Cell Biology*, 2.8.1-2.8.10 (1997).
Berzofsky et al., "Immunogenicity and Antigen Structure," in *Fundamental Immunology*. (Paul, W.E. ed.), New York, NY: Raven Press, 1993; Chapter 8, p. 242 (1 page).
Chayen, N.E., "Turning protein crystallisation from an art into a science" *Curr. Opin. Struct. Biol.*, 14:577-583 (2004).
Chayen et al., "Protein crystallization: from purified protein to diffraction-quality crystal," *Nature Methods*,5(2): 147-153 (2008).
Colman, "Effects of amino acid sequence changes on antibody-antigen interactions," *Research in Immunology*, 145:33-36 (1994).
Cot et al., "Production and characterization of highly specific anti-methotrexate monoclonal antibodies," *Hybridoma*, 6(1): 87-95 (1987).
David et al., "Characterization of monoclonal antibodies against prostaglandin $E_2$: Fine specificity and neuralization of biological effects," *Mol. Immunol.*, 22(3):339-346 (1985).
Digiammarino et al., "Ligand association rates to the inner-variable-domain of a dual-variable-domain immunoglobulin are significantly impacted by linker design," *mAbs*, 3(5): 487-494 (2011).
European Patent Application No. 09759348.7: Supplementary European Search Report and Search Opinion, dated Jul. 4, 2012 (11 pages).
European Patent Application No. 09795128.9: Supplementary European Search Report and Search Opinion, dated May 22, 2013 (10 pages).
European Patent Application No. 09831213.5: Supplementary European Search Report and Search Opinion, dated Oct. 21, 2013 (6 pages).
European Patent Application No. 10770441.3 Supplementary European Search Report and Search Opinion, dated Sep. 23, 2013 (16 pages).
European Patent Application No. 10805046.9: Supplementary European Search Report and Search Opinion, dated Mar. 26, 2013 (7 pages).
European Patent Application No. 10824164.7: Supplementary European Search Report and Search Opinion, dated May 22, 2013 (11 pages).
Ewert et al., "Stability improvement of antibodies for extracellular and intracellular applications: CDR grafting to stable frameworks and structure-based framework engineering," *Methods*, 34: 184-199 (2004).
Fuh et al., "Structure-Function Studies of Two Synthetic Anti-vascular Endothelial Growth Factor Fabs and Comparison with the Avastin™ Fab," *J. Biol. Chem.*, 281(10):6625-6631 (2006).
Germain et al., "Redirecting NK cells mediated tumor cell lysis by a new recombinant bifunctional protein," *Protein Engineering Design and Selection*, 21(11):665-672 (2008).
International Patent Application No. PCT/US2010/043716: International Preliminary Report on Patentability, dated Aug. 31, 2012 (24 pages).
International Patent Application No. PCT/US2010/054521: International Preliminary Report on Patentability, dated Feb. 8, 2012 (12 pages).
International Patent Application No. PCT/US2011/059074: International Search Report and Written Opinion, dated Jun. 15, 2012 (18 pages).
International Patent Application No. PCT/US2012/071897: International Search Report and Written Opinion, dated Sep. 3, 2013 (17 pages).
International Patent Application No. PCT/US2012/072017: International Search Report and Written Opinion, dated Jul. 17, 2013 (24 pages).

(56) References Cited

OTHER PUBLICATIONS

International Patent Application No. PCT/US2012/071929: International Search Report and Written Opinion, dated Sep. 11, 2013 (29 pages).
Janeway et al., *Immunobiology. The Immune System in Health and Disease.* 3rd Ed. Current Biology Ltd./Garland Publishing Inc., 1997; Chapter 3, pp. 1-11.
Joachimiak, "High-throughput crystallography for structural genomics" *Curr. Opin. Struct. Biol.*, 19:573-584 (2009).
Kwong et al., "Generation, affinity maturation, and characterization of a human anti-human NKG2D monoclonal antibody with dual antagonistic and agonistic activity," *J. Mol. Biol.*, 384(5): 1143-1156 (2008).
Liu et al., "Heterogeneity of Monoclonal Antibodies," *J. Pharm. Sci.*, 97(7):2426-2447 (2008).
Lo, B., "Antibody Humanization by CDR Grafting," *Methods Mol. Biol.*, 248: 135-159 (2004).
Lu et al., "Fab-scFv fusion protein: an efficient approach to production of bispecific antibody fragments," *J. Immunol. Methods*, 267:213-226 (2002).
McMahon et al., "Does Anti-TNF-Alpha Have a Role in the Treatment of Osteoporosis?" *Bulletin of the NYU Hospital for Joint Diseases*, 66: 280-281 (2008).
Mnich et al., "Characterization of a monoclonal antibody that neutralizes the activity of prostaglandin $E_2$" *J. Immunol.*, 155: 4437-4444 (1995).
Morrison et al., "Genetically Engineered Antibody Molecules," *Advances in Immunology*, 44:65-92 (1989).
National Center for Biotechnology Information (NCBI), Protein Database, "Chain H, Vascular Endothelial Growth Factor in Complex with a Neutralizing Antibody," Accession No. 1BJ1_H, ROD Jun. 30, 1998 [online]. Retrieved from the Internet: http://www.ncbi.nlm.nih.gov/protein/1BJ1_H (3 pages).
National Center for Biotechnology Information (NCBI), Protein Database, "Chain H, Vascular Endothelial Growth Factor in Complex with a Neutralizing Antibody," Accession No. 1BJ1_L, ROD Jun. 30, 1998 [online]. Retrieved from the Internet: http://www.ncbi.nlm.nih.gov/protein/4389276?sat=11&satkey=3623907 (3 pages).
National Center for Biotechnology Information (NCBI), Protein Database, "Chain H, Structure of the G6 Fab, a Phage Derived Vegf Binding Fab," Accession No. 2FJF_H, PRI Jan. 2, 2006 [online]. Retrieved from the Internet: http://www.ncbi.nlm.nih.gov/protein/90109456?sat=34&satkey=11061854 (2 pages).
National Center for Biotechnology Information (NCBI), Protein Database, "Chain L, Structure of the G6 Fab, a Phage Derived Vegf Binding Fab," Accession No. 2FJF_L, PRI Jan. 2, 2006 [online]. Retrieved from the Internet: http://www.ncbi.nlm.nih.gov/protein/90109455?sat=34&satkey=11061854 (2 pages).
National Center for Biotechnology Information (NCBI), Protein Database, "Chain H, Structure of the B20-4 Fab, a Phage Derived Fab Fragment, in Complex with Vegf," Accession No. 2FJH_H PRI Jan. 2, 2006 [online]. Retrieved from the Internet: http://www.ncbi.nlm.nih,gov/protein/901094587?sat=34&satkey=11061856 (2 pages).
National Center for Biotechnology Information (NCBI), Protein Database, "Chain L, Structure of the B20-4 Fab, a Phage Derived Fab Fragment, in Complex with Vegf," Accession No. 2FJH_L, PRI Jan. 2, 2006 [online]. Retrieved from the Internet: http://www.ncbi.nlm.nih.gov/protein/90109486?sat=34&satkey=11061856 (2 pages).
Pham, V. et al., "De novo proteomic sequencing of a monoclonal antibody raised against OX40 ligand," *Analytical Biochemistry*, 352: 77-86 (2006).
Pimm et al., "A bispecific monoclonal antibody against methotrexate and a human tumour associated antigen augments cytotoxicity of methotrexate-carrier conjugate," *Br. J. Cancer*, 61: 508-513 (1990).
Portolano et al., "Lack of promiscuity in autoantigen-specific H and L chain combinations as revealed by human H and L chain 'roulette,'" *J. Immunol.*, 150:880-887 (1993).
U.S. Appl. No. 12/477,668, filed Jun. 3, 2009 by Ghayur et al.: Non-Final Office Action, Sep. 8, 2011.
U.S. Appl. No. 12/477,668, filed Jun. 3, 2009 by Ghayur et al.: Final Office Action, May 3, 2012.
U.S. Appl. No. 12/477,711, filed Jun. 3, 2009 by Ghayur et al.: Non-Final Office Action, Aug. 11, 2011.
U.S. Appl. No. 12/477,711, filed Jun. 3, 2009 by Ghayur et al.: Final Office Action, Dec. 30, 2011.
U.S. Appl. No. 12/499,652, filed Jul. 8, 2009 by Ghayur et al.: Non-Final Office Action, May 10, 2011.
U.S. Appl. No. 12/499,652, filed Jul. 8, 2009 by Ghayur et al.: Final Office Action, Nov. 3, 2011.
U.S. Appl. No. 12/605,094, filed Oct. 23, 2009 by Ghayur et al.: Non-Final Office Action, Jun. 29, 2011.
U.S. Appl. No. 12/605,094, filed Oct. 23, 2009 by Ghayur et al.: Final Office Action, Nov. 30, 2011.
U.S. Appl. No. 12/631,483, filed Dec. 4. 2009 by Jakob et al.: Non-Final Office Action, Nov. 23, 2011.
U.S. Appl. No. 12/631,483, filed Dec. 4, 2009 by Jakob et al.: Final Office Action, Jul. 6, 2012.
U.S. Appl. No. 12/771,871, filed Apr. 30, 2010 by Ghayur et al.: Non-Final Office Action, May 16, 2012.
U.S. Appl. No. 12/771,874, filed Apr. 30, 2010 by Ghayur et al.: Non-Final Office Action, Sep. 7, 2012.
U.S. Appl. No. 12/771,874, filed Apr. 30, 2010 by Ghayur et al.: Non-Final Office Action, Apr. 18, 2013.
U.S. Appl. No. 12/771,874, filed Apr. 30, 2010 by Ghayur et al.: Final Office Action, Nov. 12, 2013.
U.S. Appl. No. 12/873,926, filed Sep. 1, 2010 by Ghayur et al.: Non-Final Office Action, Aug. 28, 2012.
U.S. Appl. No. 12/873,926, filed Sep. 1, 2010 by Ghayur et al.: Final Office Action, Mar. 12, 2013.
U.S. Appl. No. 12/905,474, filed Oct. 15, 2010 by Ghayur et al.: Non-Final Office Action, May 29, 2013.
U.S. Appl. No. 13/167,323, filed Jun. 23, 2011 by Ghayur et al.: Non-Final Office Action, Jun. 4, 2013.
U.S. Appl. No. 13/167,323, filed Jun. 23, 2011 by Ghayur et al.: Final Office Action, Nov. 20, 2013.
U.S. Appl. No. 13/196,138, filed Aug. 2, 2011 by Ghayur et al.: Non-Final Office Action, Nov. 27, 2012.
U.S. Appl. No. 13/217,937, filed Aug. 25, 2011 by Ghayur et al.: Non-Final Office Action, Sep. 6, 2012.
U.S. Appl. No. 13/217,937, filed Aug. 25, 2011 by Ghayur et al.; Final Office Action, Mar. 20, 2013.
U.S. Appl. No. 13/286,707, filed Nov. 1, 2011 by Ghayur et al.: Non-Final Office Action Feb. 25 2013.
U.S. Appl. No. 13/286,707, filed Nov. 1, 2011 by Ghayur et al.: Final Office Action, Jul. 17, 2013.
Voet et al. (Eds), *Biochemistry*, John Wiley & Sons, Inc., 1999; p. 1100.
Voller et al., "Enzyme immunoassays with special reference to ELISA techniques," *J. Clin. Pathol.*, 31:507-520 (1978).
Wang et al., "Antibody Structure, Instability, and Formulation," *J. Pharm. Sci.*, 96(1): 1-26 (2007).
Wu et al., "Generation and Characterization of a Dual Variable Domain Immunoglobulin (DVD-Ig™) Molecule," in *Antibody Engineering*, vol. 2. R. Kontermann and S. Dübel (Eds.), Springer-Verlag, 2010; pp. 239-250.
Genbank X99230, X99232 (Oct. 8, 1996).
Alegre et at "An Anti-Murine CD3 Monoclonal Antibody with a Low Affinity for Fcγ Receptors Suppresses Transplantation Responses While Minimizing Acute Toxicity and Immunogenicity," *J. Immunol.*, 155: 1544-1555 (1995).
Balthasar et al., "High-affinity rabbit antibodies directed against methotrexate: Production, purification, characterization, and pharmacokinetics in the rat," *J. Pharm. Sci.*, 84(1): 2-6 (1995) (Abstract only).
Balthasar et al., "Inverse Targeting of Peritoneial Tumors: Selective Alteration of the Disposition of Methotrexate through the Use of Anti-Methotrexate Antibodies and Antibody Fragments," *J. Pharm. Sci.*, 85(10): 1035-1043 (1996).
Barrios et al., "Length of the antibody heavy chain complementarity determining region 3 as a specificity-determining factor" *J. Mol. Recog.* 17: 332-338 (2004).

(56) References Cited

OTHER PUBLICATIONS

Casset et al., "A peptide mimetic of an anti-CD4 monoclonal antibody by rational design," *Biochem. Biophys. Res. Commun.*, 307: 198-205 (2003).
Chen et al., "Selection and analysis of an optimized anti-VEGF antibody: crystal structure of an affinity matured Fab in complex with antigen," *J. Mol. Biol.*, 293: 865-881 (1999).
Chengbin et al., "Simultaneous targeting of multiple disease mediators by a dual-variable-domain immunoglobulin," *Nature Biotechnol.*, 25(11):1290-1297 (2007).
De Pascalis et al., "Grafting of abbreviated complementarity determining regions containing specificity determining residues essential for ligand contact to engineer a less immunogenic humanized monoclonal antibody," *J. Immunol.* 169: 3076-3084 (2002).
European Patent Application No. 06813554.0: Supplementary European Search Report and Search Opinion, dated Sep. 21, 2009.
European Patent Application No. 07811045.9: Supplementary European Search Report and Search Opinion, dated Sep. 21, 2009.
European Patent Application No. 09739578.4: Supplementary European Search Report and Search Opinion, dated Mar. 28, 2012.
GenBank Accession No. U17870, "*Cricetulus migratorius* 145.2c11 kappa light chain mRNA, complete cds," ROD Feb. 7, 1996.
GenBank Accession No. U17871, "*Cricetulus migratorius* 145.2c11 heavy chain mRNA, partial cds," Feb. 7, 1996.
GenBank Accession No. Y14283, "*Mus musculus* mRNA for immunoglobulin heavy chain variable region, subunits VH, DH and JH'" ROD May 26, 1998.
GenBank Accession No. Y14284, "*Mus musculus* mRNA for immunoglobulin light chain variable region, subunits VL and JL," ROD May 26, 1998.
Güssow et al., "Humanization of Monoclonal Antibodies," *Methods in Enzymology*, 203:99-121 (1991).
Henry et al., "A Prostate-Specific Membrane Antigen Targeted Monoclonal Antibody-Chemotherapeutic Conjugate Designed for the Treatment of Prostate Cancer," *Cancer Res.* 64: 7995-8001 (2004).
Holm et al., "Functional mapping and single chain construction of the anti-cytokeratin 8 monoclonal antibody TS1,"*Mol. Immunol.*, 44: 1075-1084 (2007).
International Patent Application No. PCT/US2009/041945: International Preliminary Report on Patentability, dated Aug. 9, 2010.
International Patent Application No. PCT/US2009/041945: International Search Report and Written Opinion, dated Nov. 2, 2009.
International Patent Application No. PCT/US2009/046130: International Preliminary Report on Patentability, dated Aug. 21, 2010.
International Patent Application No. PCT/US2009/046130: International Search Report and Written Opinion, dated Jan. 1, 2010.
International Patent Application No. PCT/US2009/046137: International Preliminary Report on Patentability, dated Jun. 18, 2010.
International Patent Application No. PCT/US2009/046137: International Search Report and Written Opinion, dated Jan. 12, 2010.
International Patent Application No. PCT/US2009/049954: International Preliminary Report on Patentability, dated Jul. 2, 2011.
International Patent Application No. PCT/US2009/049954: International Search Report and Written Opinion, dated Mar. 31, 2010.
International Patent Application No. PCT/US2009/066815: International Preliminary Report on Patentability, dated Jan. 6, 2011.
International Patent Application No. PCT/US2009/066815: International Search Report and Written Opinion, dated Mar. 23, 2010.
International Patent Application No. PCT/US2010/033231: International Preliminary Report on Patentability, dated Apr. 27, 2011.
International Patent Application No. PCT/US2010/033231: International Search Report and Written Opinion, dated Nov. 22, 2010.
International Patent Application No. PCT/US2010/033246: International Preliminary Report on Patentability, dated May 4, 2011.
International Patent Application No. PCT/US2010/033246: International Search Report and Written Opinion, dated Nov. 24, 2010.
International Patent Application No. PCT/US2010/043716: International Search Report and Written Opinion, dated Feb. 28, 2011.
International Patent Application No. PCT/US2010/047543: International Search Report and Written Opinion, dated Feb. 11, 2011.
International Patent Application No. PCT/US2010/052843: International Search Report and Written Opinion, dated Jul. 1, 2011.
International Patent Application No. PCT/US2010/053730: International Preliminary Report on Patentability, dated Nov. 23, 2011.
International Patent Application No. PCT/US2010/053730: International Search Report and Written Opinion, dated May 6, 2011.
International Patent Application No. PCT/US2010/054521: International Search Report and Written Opinion, dated May 26, 2011.
Jendreyko et al., "Intradiabodies, Bispecific, Tetravalent Antibodies for the Simultaneous Functional Knockout of Two Cell Surface Receptors," *J. Biol. Chem.*, 278(48):47812-47819 (2003).
Jin et al., "Pharmacokinetic and Pharmacodynamic Effects of High-dose Monoclonal Antibody Therapy in a Rat Model of Immune Thrombocytopenia," *The AAPS Journal*, 7(4):Article 87, E895-E902 (2006) [online]. Retrieved from: http://www.springerlink.com/content/v6n04672761n9313/fulltext.pdf.
Ju et al., "Inhibitory effects of nardostachin on nitric oxide, prostaglandin E2, and tumor necrosis factor-alpha production in lipopolysaccharide activated macrophages," *Biol. Pharm. Bull.* 26: 1375-1378 (2003).
Lobo, "Anti-Methotrexate Fab Fragments for Optimization of Intraperitoneal Methotrexate Chemotherapy," Dissertation, University of New York at Buffalo, Dept. of Pharmaceutical Sciences, Aug. 2002, pp. 1-243. Available online at: http://www.acsu.buffalo.edu/~jb/Thesis%20080802.pdf.
Lobo et al., "Application of anti-methotrexate Fab fragments for the optimization of intraperitoneal methotrexate therapy in a murine model of peritoneal cancer," *J. Pharma. Sci.*, 94(9): 1957-1964 (2005) (abstract only).
Malik-Hall et al., "Primary afferent nociceptor mechanisms mediating NGF-induced mechanical hyperalgesia," *Eur. J. Neurosci.*, 21(12): 3387-3394 (2005).
Mariuzza et al., "The Structural Basis of Antigen-Antibody Recognition," *Annu. Rev. Biophys. Biophys. Chem.*, 16: 139-159 (1987).
Piatesi et al., "Immunological Optimization of a Generic Hydrophobic Pocket for High Affinity Hapten Binding and Diels-Alder Activity," *ChemBioChem* 5: 460-466 (2004).
Qu et al., "Bispecific anti-CD20/22 antibodiees inhibit B-cell lymphoma proliferation by a unique mechanism of action," *Blood*, 111(4):2211-2219 (2007).
Reusch et al., "Anti-CD3 × Anti-Epidermal Growth Factor Receptor (EGFR) Bispecific Antibody Redirects T Cell Cytolytic Activity to EGFR-Positive Cancers in vitro and in an Animal Model," *Clin. Cancer Res.*, 12(1): 183-190 (2006).
Riemer et al., "Matching of trastuzumab (Herceptin®) epitope mimics onto the surface of Her-2/neu—a new method of epitope definition" *Mol. Immunol.*, 42: 1121-1124 (2005).
Rudikoff et al., "Single amino acid substitution altering antigen binding specificity," *Proc. Natl. Acad. Sci. USA*, 79: 1979-1983 (1982).
Shalaby et al., "Development of Humanized Bispecific Antibodies Reactive with Cytotoxic Lymphocytes and Tumor Cells Overexpressing the HER2 Protooncogene," *J. Exp. Med.*, 175: 217-225 (1992).
Stancovski et al., "Mechanistic aspects of the opposing effects of monoclonal antibodies to the ERBB2 receptor on tumor growth," *Proc. Natl. Acad. Sci. USA* 88: 8691-8695 (1991).
Steffen et al., "Basic studies on enzyme therapy of immune complex diseases" *Wien Klin. Wochenschr.*, 97(8): 376-385 (1985) (Abstract only).
Tol et al., "Chemotherapy, Bevacizumab, and Cetuximab in Metastatic Colorectal Cancer," *N. Engl. J. Med.*, 360(6): 563-572 (2009).
Vajdos et al., "Comprehensive functional maps of the antigen-binding site of an anti-ErbB2 antibody obtained with shotgun scanning mutagenesis," *J. Mol. Biol.* 320: 415-428 (2002).
Wu et al., "Humanization of a murine monoclonal antibody by simultaneous optimization of framework and CDR residues," *J. Mol. Biol.*, 294: 151-162 (1999).
Wu et al., "Molecular construction and optimization of anti-human IL-1α/β dual variable domain immunoglobulin (DVD-Ig™) molecules," *mAbs*, 1(4): 339-347 (2009).

(56) References Cited

OTHER PUBLICATIONS

Zhang et al., "Inhibition of Cyclooxygenase-2 Rapidly Reverses Inflammatory Hyperalgesia and Prostaglandin E2 Production," *J. Pharmacol. Exp. Ther.*, 283(3): 1069-1075 (1997).

Desplat-Jego et al., "Anti-TWEAK monoclonal antibodies reduce immune cell infiltration in the central nervous system and severity of experimental autoimmune encephalomyelitis," *Clin. Immunol.*, 117(1):15-23 (2005).

Dohi et al, "Effect of combination Treatment with TNF-Inhibitor and Anti-TWEAK Antibody in Mouse Colitis Model," *Gastroenterology*, 138(5): S-413, Abstract M1758 (2010).

European Patent Application No. 11804385.0: Supplementary European Search Report and Search Opinion dated Nov. 20, 2013 (16 pages).

European Patent Application No. 11798923.6: Supplementary European Search Report and Search Opinion, dated Jan. 2, 2014 (10 pages).

European Patent Application No. 11820654.9: Supplementary European Search Report and Search Opinion, dated Dec. 17, 2013 (17 pages).

Inter Partes Reexamination (Control No. 95/001,380) of U.S. Patent No. 7,612,181 (U.S. Appl. No. 11/507,050): Reexamination Non-Final Office Action ("Action Closing Prosecution"), dated Sep. 1, 2011.

Inter Partes Reexamination (Control No. 95/001,380) of U.S. Patent No. 7,612,181 (U.S. Appl. No. 11/507,050): Patent Owner Comments After Action Closing Prosecution ("Response Pursuant to 37 CFR § 1.951(a)"), dated Oct. 31, 2011.

Inter Partes Reexamination (Control No. 95/001,380) of U.S. Patent No. 7,612,181 (U.S. Appl. No. 11/507,050): Third Party Requester Comments after Action Closing Prosecution ("Sanofi's Comments Pursuant to 37 CFR §1.951(a)"), dated Nov. 30, 2011.

Inter Partes Reexamination (Control No. 95/001,380) of U.S. Patent No. 7,612,181 (U.S. Appl. No. 11/507,050): Right of Appeal Notice (37 CFR 1.953), dated Mar. 7, 2012.

International Patent Application No. PCT/US2013/067873: International Search Report and Written Opinion, dated May 8, 2014 (23 pages).

Jakubowski et al., "Dual role for TWEAK in angiogenic regulation," *J. Cell Sci.*, 115(2):267-274 (2002).

Michaelson, J., "Dual Targeting of TNF and TWEAK in Inflammatory Bowel Disease: The Promise of a Bispecific Antibody," Conference, Cytokines & Inflammation, Jan. 28, 2011; Agenda, p. 11. Retrieved from the Internet: http://www.cytokinesandinflammation.com/Index.php?option=com_content&view=article&id=50&itemid=54.

Portanova et al., "Selective Neutralization of Prostaglandin $E_2$ Blocks Inflammation, Hyperalgesia, and Interleukin 6 Production in Vivo," *J. Exp. Med.*, 184(3): 883-891 (1996).

Streppel et al., "Focal application of neutralizing antibodies to soluble neurotrophic factors reduces collateral axonal branching after peripheral nerve lesion," *Eur. J. Neurosci.*, 15(8): 1327-1342 (2002).

Winkles, J., "The TWEAK-Fn14 cytokine-receptor axis: discovery, biology and therapeutic targeting," *Nature Reviews. Drug Disc.*, 7(5):411-425 (2008).

U.S. Appl. No. 12/477,668, filed Jun. 3, 2009 by Ghayur et al.: Final Office Action, Mar. 10, 2014.

U.S. Appl. No. 12/477,711, filed Jun. 3, 2009 by Ghayur et al.: Non-Final Office Action, Jul. 17, 2013.

U.S. Appl. No. 12/477,711, filed Jun. 3, 2009 by Ghayur et al.: Final Office Action, Feb. 7, 2014.

U.S. Appl. No. 12/499,652, filed Jul. 8, 2009 by Ghayur et al.: Notice of Allowance, Apr. 10, 2014.

U.S. Appl. No. 12/771,871, filed Apr. 30, 2010 by Ghayur et al.: Final Office Action, May 28, 2013.

U.S. Appl. No. 12/771,871, filed Apr. 30, 2010 by Ghayur et al.: Non-Final Office Action, Apr. 15, 2014.

U.S. Appl. No. 12/846,317, filed Jul. 29, 2010 by Ghayur et al.: Final Office Action, May 23, 2013.

U.S. Appl. No. 12/846,317, filed Jul. 29, 2010 by Ghayur et al.: Non-Final Office Action, Nov. 6, 2013.

U.S. Appl. No. 12/873,926, filed Sep. 1, 2010 by Ghayur et al.: Notice of Allowance, Jul. 24, 2013.

U.S. Appl. No. 12/905,474, filed Oct. 15, 2010 by Ghayur et al.: Notice of Allowance, Jan. 10, 2014.

U.S. Appl. No. 12/914,614, filed Oct. 28, 2010 by Ghayur et al.: Non-Final Office Action, Jun. 6, 2013.

U.S. Appl. No. 12/914,614, filed Oct. 28, 2010 by Ghayur et al.: Notice of Allowance, Jan. 10, 2014.

U.S. Appl. No. 13/196,138, filed Aug. 2, 2011 by Ghayur et al.: Notice of Allowance, Jan. 16, 2014.

U.S. Appl. No. 13/286,707, filed Nov. 1, 2011 by Ghayur et al.: Non-Final Office Action, Jan. 29, 2014.

\* cited by examiner

DUAL VARIABLE DOMAIN IMMUNOGLOBULINS AND USES THEREOF

REFERENCE TO RELATED APPLICATIONS

This application is a non-provisional application claiming priority to U.S. Provisional Application Ser. No. 61/125,834, filed Apr. 29, 2008, U.S. Provisional Application Ser. No. 61/134,283, filed Jul. 8, 2008, U.S. Provisional Application Ser. No. 61/197,191, filed Oct. 23, 2008, and U.S. Provisional Application Ser. No. 61/199,009, filed Nov. 12, 2008, the contents of which are hereby incorporated by reference.

FIELD OF THE INVENTION

The present invention relates to multivalent and multispecific binding proteins, methods of making, and specifically to their uses in the, diagnosis, prevention and/or treatment of acute and chronic inflammatory diseases, cancer, and other diseases.

BACKGROUND OF THE INVENTION

Engineered proteins, such as multispecific antibodies capable of binding two or more antigens are known in the art. Such multispecific binding proteins can be generated using cell fusion, chemical conjugation, or recombinant DNA techniques.

Bispecific antibodies have been produced using quadroma technology (see Milstein, C. and A. C. Cuello (1983) Nature 305(5934):537-40) based on the somatic fusion of two different hybridoma cell lines expressing murine monoclonal antibodies (mAbs) with the desired specificities of the bispecific antibody. Because of the random pairing of two different immunoglobulin (Ig) heavy and light chains within the resulting hybrid-hybridoma (or quadroma) cell line, up to ten different Ig species are generated, of which only one is the functional bispecific antibody. The presence of mis-paired by-products, and significantly reduced production yields, means sophisticated purification procedures are required.

Bispecific antibodies can also be produced by chemical conjugation of two different mAbs (see Staerz, U. D., et al. (1985) Nature 314(6012): 628-31). This approach does not yield homogeneous preparation. Other approaches have used chemical conjugation of two different mAbs or smaller antibody fragments (see Brennan, M., et al. (1985) Science 229 (4708): 81-3).

Another method used to produce bispecific antibodies is the coupling of two parental antibodies with a hetero-bifunctional crosslinker, but the resulting bispecific antibodies suffer from significant molecular heterogeneity because reaction of the crosslinker with the parental antibodies is not site-directed. To obtain more homogeneous preparations of bispecific antibodies two different Fab fragments have been chemically crosslinked at their hinge cysteine residues in a site-directed manner (see Glennie, M. J., et al. (1987) J. Immunol. 139(7): 2367-75). But this method results in Fab'2 fragments, not full IgG molecule.

A wide variety of other recombinant bispecific antibody formats have been developed (see Kriangkum, J., et al. (2001) Biomol. Eng. 18(2): 31-40). Amongst them tandem single-chain Fv molecules and diabodies, and various derivatives thereof, are the most widely used. Routinely, construction of these molecules starts from two single-chain Fv (scFv) fragments that recognize different antigens (see Economides, A. N., et al. (2003) Nat. Med. 9(1): 47-52). Tandem scFv molecules (taFv) represent a straightforward format simply connecting the two scFv molecules with an additional peptide linker. The two scFv fragments present in these tandem scFv molecules form separate folding entities. Various linkers can be used to connect the two scFv fragments and linkers with a length of up to 63 residues (see Nakanishi, K., et al. (2001) Ann. Rev. Immunol. 19: 423-74). Although the parental scFv fragments can normally be expressed in soluble form in bacteria, it is, however, often observed that tandem scFv molecules form insoluble aggregates in bacteria. Hence, refolding protocols or the use of mammalian expression systems are routinely applied to produce soluble tandem scFv molecules. In a recent study, in vivo expression by transgenic rabbits and cattle of a tandem scFv directed against CD28 and a melanoma-associated proteoglycan was reported (see Gracie, J. A., et al. (1999) J. Clin. Invest. 104(10): 1393-401). In this construct, the two scFv molecules were connected by a CH1 linker and serum concentrations of up to 100 mg/L of the bispecific antibody were found. Various strategies including variations of the domain order or using middle linkers with varying length or flexibility were employed to allow soluble expression in bacteria. A few studies have now reported expression of soluble tandem scFv molecules in bacteria (see Leung, B. P., et al. (2000) J. Immunol. 164(12): 6495-502; Ito, A., et al. (2003) J. Immunol. 170(9): 4802-9; Karni, A., et al. (2002) J. Neuroimmunol. 125(1-2): 134-40) using either a very short Ala3 linker or long glycine/serine-rich linkers. In another recent study, phage display of a tandem scFv repertoire containing randomized middle linkers with a length of 3 or 6 residues was employed to enrich for those molecules that are produced in soluble and active form in bacteria. This approach resulted in the isolation of a tandem scFv molecule with a 6 amino acid residue linker (see Arndt, M. and J. Krauss (2003) Methods Mol. Biol. 207: 305-21). It is unclear whether this linker sequence represents a general solution to the soluble expression of tandem scFv molecules. Nevertheless, this study demonstrated that phage display of tandem scFv molecules in combination with directed mutagenesis is a powerful tool to enrich for these molecules, which can be expressed in bacteria in an active form.

Bispecific diabodies (Db) utilize the diabody format for expression. Diabodies are produced from scFv fragments by reducing the length of the linker connecting the VH and VL domain to approximately 5 residues (see Peipp, M. and T. Valerius (2002) Biochem. Soc. Trans. 30(4): 507-11). This reduction of linker size facilitates dimerization of two polypeptide chains by crossover pairing of the VH and VL domains. Bispecific diabodies are produced by expressing, two polypeptide chains with, either the structure VHA-VLB and VHB-VLA (VH-VL configuration), or VLA-VHB and VLB-VHA (VL-VH configuration) within the same cell. A large variety of different bispecific diabodies have been produced in the past and most of them are expressed in soluble form in bacteria. However, a recent comparative study demonstrates that the orientation of the variable domains can influence expression and formation of active binding sites (see Mack, M. et al. (1995) Proc. Natl. Acad. Sci. USA 92(15): 7021-5). Nevertheless, soluble expression in bacteria represents an important advantage over tandem scFv molecules. However, since two different polypeptide chains are expressed within a single cell inactive homodimers can be produced together with active heterodimers. This necessitates the implementation of additional purification steps in order to obtain homogenous preparations of bispecific diabodies. One approach to force the generation of bispecific diabodies is the production of knob-into-hole diabodies (see Holliger, P., T. Prospero, and G. Winter (1993) Proc. Natl. Acad. Sci. USA 90(14): 6444-8.18). This approach was demonstrated for a bispecific diabody directed against HER2 and CD3. A large knob was introduced in the VH domain by exchanging Val37 with Phe and Leu45 with Trp and a complementary hole was produced in the VL domain by mutating Phe98 to Met and Tyr87 to Ala, either in the anti-HER2 or the anti-CD3 variable domains. By using this approach the production of bispecific diabodies could be increased from 72% by the parental diabody to over 90% by the knob-into-hole diabody. Importantly, production yields only slightly decrease as a result of these mutations. However, a reduction in antigen-binding activity was observed for several constructs. Thus, this rather elaborate approach requires the analysis of various constructs in order to identify those mutations that produce heterodimeric molecule with unaltered binding activity. In addition, such approach requires mutational modification of the immunoglobulin sequence at the constant region, thus creating non-native and non-natural form of the antibody sequence, which may result in increased immunogenicity, poor in vivo stability, as well as undesirable pharmacokinetics.

Single-chain diabodies (scDb) represent an alternative strategy for improving the formation of bispecific diabody-like molecules (see Holliger, P. and G. Winter (1997) Cancer Immunol. Immunother. 45(3-4): 128-30; Wu, A. M., et al. (1996) Immunotechnology 2(1): p. 21-36). Bispecific single-chain diabodies are produced by connecting the two diabody-forming polypeptide chains with an additional middle linker with a length of approximately 15 amino acid residues. Consequently, all molecules with a molecular weight corresponding to monomeric single-chain diabodies (50-60 kDa) are bispecific. Several studies have demonstrated that bispecific single chain diabodies are expressed in bacteria in soluble and active form with the majority of purified molecules present as monomers (see Holliger, P. and G. Winter (1997) Cancer Immunol. Immunother. 45(3-4): 128-30; Wu, A. M., et al. (1996) Immunotechnol. 2(1): 21-36; Pluckthun, A. and P. Pack (1997) Immunotechnol. 3(2): 83-105; Ridgway, J. B., et al. (1996) Protein Engin. 9(7): 617-21). Thus, single-chain diabodies combine the advantages of tandem scFvs (all monomers are bispecific) and diabodies (soluble expression in bacteria).

More recently diabodies have been fused to Fc to generate more Ig-like molecules, named di-diabodies (see Lu, D., et al. (2004) J. Biol. Chem. 279(4): 2856-65). In addition, multivalent antibody construct comprising two Fab repeats in the heavy chain of an IgG and capable of binding four antigen molecules has been described (see WO 0177342A1, and Miller, K., et al. (2003) J. Immunol. 170(9): 4854-61).

There is a need in the art for improved multivalent binding proteins capable of binding two or more antigens. U.S. patent application Ser. No. 11/507,050 provides a novel family of binding proteins capable of binding two or more antigens with high affinity, which are called dual variable domain immunoglobulins (DVD-Ig™). The present invention provides further novel binding proteins capable of binding two or more antigens.

SUMMARY OF THE INVENTION

This invention pertains to multivalent binding proteins capable of binding two or more antigens. The present invention provides a novel family of binding proteins capable of binding two or more antigens with high affinity.

In one embodiment the invention provides a binding protein comprising a polypeptide chain, wherein the polypeptide chain comprises VD1-(X1)n-VD2-C-(X2)n, wherein VD1 is a first variable domain, VD2 is a second variable domain, C is a constant domain, X1 represents an amino acid or polypeptide, X2 represents an Fc region and n is 0 or 1. In an embodiment the VD1 and VD2 in the binding protein are heavy chain variable domains. In another embodiment, the heavy chain variable domain is selected from the group consisting of a murine heavy chain variable domain, a human heavy chain variable domain, a CDR grafted heavy chain variable domain, and a humanized heavy chain variable domain. In yet another, embodiment VD1 and VD2 are capable of binding the same antigen. In another embodiment VD1 and VD2 are capable of binding different antigens. In still another embodiment, C is a heavy chain constant domain. For example, X1 is a linker with the proviso that X1 is not CH1. For example, X1 is a linker selected from the group consisting of AKTTPKLEEGEFSEAR (SEQ ID NO: 1); AKTTPKLEEGEFSEARV (SEQ ID NO: 2); AKTTPKLGG (SEQ ID NO: 3); SAKTTPKLGG (SEQ ID NO: 4); SAKTTP (SEQ ID NO: 5); RADAAP (SEQ ID NO: 6); RADAAPTVS (SEQ ID NO: 7); RADAAAAGGPGS (SEQ ID NO: 8); RADAAAA(G4S)4 (SEQ ID NO: 9); SAKTTPKLEEGEFSEARV (SEQ ID NO: 10); ADAAP (SEQ ID NO: 11); ADAAPTVSIFPP (SEQ ID NO: 12); TVAAP (SEQ ID NO: 13); TVAAPSVFIFPP (SEQ ID NO: 14); QPKAAP (SEQ ID NO: 15); QPKAAPSVTLFPP (SEQ ID NO: 16); AKTTPP (SEQ ID NO: 17); AKTTPPSVTPLAP (SEQ ID NO: 18); AKTTAP (SEQ ID NO: 19); AKTTAPSVYPLAP (SEQ ID NO: 20); ASTKGP (SEQ ID NO: 21); ASTKGPSVFPLAP (SEQ ID NO: 22), GGGGSGGGGSGGGGS (SEQ ID NO: 23); GENKVEYAPALMALS (SEQ ID NO: 24); GPAKELTPLKEAKVS (SEQ ID NO: 25); GHEAAAVMQVQYPAS (SEQ ID NO: 26). In an embodiment, X2 is an Fc region. In another embodiment, X2 is a variant Fc region.

In an embodiment the binding protein disclosed herein comprises a polypeptide chain, wherein the polypeptide chain comprises VD1-(X1)n-VD2-C-(X2)n, wherein VD1 is a first heavy chain variable domain, VD2 is a second heavy chain variable domain, C is a heavy chain constant domain, X1 is a linker with the proviso that it is not CH1, and X2 is an Fc region.

In an embodiment, VD1 and VD2 in the binding protein are light chain variable domains. In an embodiment, the light chain variable domain is selected from the group consisting of a murine light chain variable domain, a human light chain variable domain, a CDR grafted light chain variable domain, and a humanized light chain variable domain. In one embodiment VD1 and VD2 are capable of binding the same antigen. In another embodiment VD1 and VD2 are capable of binding different antigens. In an embodiment, C is a light chain constant domain. In another embodiment, X1 is a linker with the proviso that X1 is not CL1. In an embodiment, X1 is a linker selected from the group consisting of AKTTPKLEEGEFSEAR (SEQ ID NO: 1); AKTTPKLEEGEFSEARV (SEQ ID NO: 2); AKTTPKLGG (SEQ ID NO: 3); SAKTTPKLGG (SEQ ID NO: 4); SAKTTP (SEQ ID NO: 5); RADAAP (SEQ ID NO: 6); RADAAPTVS (SEQ ID NO: 7); RADAAAAGGPGS (SEQ ID NO: 8); RADAAAA(G4S)4 (SEQ ID NO: 9); SAKTTPKLEEGEFSEARV (SEQ ID NO: 10); ADAAP (SEQ ID NO: 11); ADAAPTVSIFPP (SEQ ID NO: 12); TVAAP (SEQ ID NO: 13); TVAAPSVFIFPP (SEQ ID NO: 14); QPKAAP (SEQ ID NO: 15); QPKAAPSVTLFPP (SEQ ID NO: 16); AKTTPP (SEQ ID NO: 17); AKTTPPSVTPLAP (SEQ ID NO: 18); AKTTAP (SEQ ID NO: 19); AKTTAPSVYPLAP (SEQ ID NO: 20); ASTKGP (SEQ ID NO: 21); ASTKGPSVFPLAP (SEQ ID NO: 22) GGGGSGGGGSGGGGS (SEQ ID NO: 23); GENKVEYAPALMALS (SEQ ID NO: 24); GPAKELTPLKEAKVS (SEQ ID NO: 25); GHEAAAVMQVQYPAS (SEQ ID NO: 26). In an embodiment, the binding protein does not comprise X2.

In an embodiment, both the variable heavy and variable light chain comprise the same linker. In another embodiment, the variable heavy and variable light chain comprise different linkers. In another embodiment, both the variable heavy and variable light chain comprise a short (about 6 amino acids) linker. In another embodiment, both the variable heavy and variable light chain comprise a long (greater than 6 amino acids) linker. In another embodiment, the variable heavy chain comprises a short linker and the variable light chain comprises a long linker. In another embodiment, the variable heavy chain comprises a long linker and the variable light chain comprises a short linker.

In an embodiment the binding protein disclosed herein comprises a polypeptide chain, wherein said polypeptide chain comprises VD1-(X1)n-VD2-C-(X2)n, wherein VD1 is a first light chain variable domain, VD2 is a second light chain variable domain, C is a light chain constant domain, X1 is a linker with the proviso that it is not CH1, and X2 does not comprise an Fc region.

In another embodiment the invention provides a binding protein comprising two polypeptide chains, wherein said first polypeptide chain comprises VD1-(X1)n-VD2-C-(X2)n, wherein VD1 is a first heavy chain variable domain, VD2 is a second heavy chain variable domain, C is a heavy chain constant domain, X1 is a linker with the proviso that it is not CH1, and X2 is an Fc region; and said second polypeptide chain comprises VD1-(X1)n-VD2-C-(X2)n, wherein VD1 is a first light chain variable domain, VD2 is a second light chain variable domain, C is a light chain constant domain, X1 is a linker with the proviso that it is not CH1, and X2 does not comprise an Fc region. In a particular embodiment, the Dual Variable Domain (DVD) binding protein comprises four polypeptide chains wherein the first two polypeptide chains comprises VD1-(X1)n-VD2-C-(X2)n, respectively wherein VD1 is a first heavy chain variable domain, VD2 is a second heavy chain variable domain, C is a heavy chain constant domain, X1 is a linker with the proviso that it is not CH1, and X2 is an Fc region; and the second two polypeptide chain comprises VD1-(X1)n-VD2-C-(X2)n respectively, wherein VD1 is a first light chain variable domain, VD2 is a second light chain variable domain, C is a light chain constant domain, X1 is a linker with the proviso that it is not CH1, and X2 does not comprise an Fc region. Such a Dual Variable Domain (DVD) protein has four antigen binding sites.

In another embodiment the binding proteins disclosed herein are capable of binding one or more targets. In an embodiment, the target is selected from the group consisting of cytokines, cell surface proteins, enzymes and receptors. In another embodiment, the binding protein is capable of modulating a biological function of one or more targets. In another embodiment, the binding protein is capable of neutralizing one or more targets. The binding protein of the invention is capable of binding cytokines selected from the group consisting of lymphokines, monokines, polypeptide hormones, receptors, or tumor markers. For example, the DVD-Ig of the invention is capable of binding two or more of the following: CD-20, CD-19, CD-80, CD-22, CD-40, CD-3, human epidermal growth factor receptor 2 (HER-2), epidermal growth factor receptor (EGFR), insulin-like growth factor 1,2 (IGF1, 2), insulin-like growth factor receptor (IGF1R), macrophage stimulating protein receptor tyrosine kinase (RON), hepatocyte growth factor (HGF), mesenchymal-epithelial transition factor (c-MET), vascular endothelial growth factor (VEGF), Drosophila Delta homologue 4 (DLL4), neuropilin 1 (NRP1), placental growth factor (PLGF), v-erbb2 avian erythroblastic leukemia viral oncogene homolog 3 (ErbB3) (see also Table 2). In a specific embodiment the binding protein is capable of binding pairs of targets selected from the group consisting of CD-20 and CD-19; CD-20 and CD-80; CD-20 and CD-22; CD-20 and CD-40; CD-3 and HER-2; CD-3 and CD-19; EGFR and HER-2; EGFR and CD-3; EGFR and IGF1,2; EGFR and IGF1R; EGFR and RON; EGFR and HGF; EGFR and c-MET; HER-2 and IGF1,2; HER-2 and IGF1R; RON and HGF; VEGF and EGFR; VEGF and HER-2; VEGF and CD-20; VEGF and IGF1,2; VEGF and DLL4; VEGF and HGF; VEGF and RON; VEGF and NRP1; CD-20 and CD3; DLL-4 and PLGF; VEGF and PLGF; ErbB3 and EGFR; ErbB3 and HGF; HER-2 and ErbB3; c-Met and ErB3; PLGF and HER-2; HER-2 and HER-2.

In an embodiment, the binding protein capable of binding CD-20 and CD-19 comprises a DVD heavy chain amino acid sequence selected from the group consisting of SEQ ID NO. 99 and SEQ ID NO. 101; and a DVD light chain amino acid sequence selected from the group consisting of SEQ ID NO. 100 and SEQ ID NO. 102. In an embodiment, the binding protein capable of binding CD-20 and CD-19 comprises a DVD heavy chain amino acid sequence of SEQ ID NO. 99 and a DVD light chain amino acid sequence of SEQ ID NO: 100. In another embodiment, the binding protein capable of binding CD-20 and CD-19 has a reverse orientation and comprises a DVD heavy chain amino acid sequence of SEQ ID NO. 101 and a DVD light chain amino acid sequence of SEQ ID NO: 102.

In an embodiment, the binding protein capable of binding CD-20 and CD-3 (seq. 1) comprises a DVD heavy chain amino acid sequence selected from the group consisting of SEQ ID NO. 103 and SEQ ID NO. 105; and a DVD light chain amino acid sequence selected from the group consisting of SEQ ID NO. 104 and SEQ ID NO. 106. In an embodiment, the binding protein capable of binding CD-20 and CD-3 (seq. 1) comprises a DVD heavy chain amino acid sequence of SEQ ID NO. 103 and a DVD light chain amino acid sequence of SEQ ID NO: 104. In another embodiment, the binding protein capable of binding CD-20 and CD-3 (seq. 1) has a reverse orientation and comprises a DVD heavy chain amino acid sequence of SEQ ID NO. 105 and a DVD light chain amino acid sequence of SEQ ID NO: 106.

In an embodiment, the binding protein capable of binding CD-20 and CD-80 comprises a DVD heavy chain amino acid sequence selected from the group consisting of SEQ ID NO. 107 and SEQ ID NO. 109; and a DVD light chain amino acid sequence selected from the group consisting of SEQ ID NO. 108 and SEQ ID NO. 110. In an embodiment, the binding protein capable of binding CD-20 and CD-80 comprises a DVD heavy chain amino acid sequence of SEQ ID NO. 107 and a DVD light chain amino acid sequence of SEQ ID NO: 108. In another embodiment, the binding protein capable of binding CD-20 and CD-80 has a reverse orientation and comprises a DVD heavy chain amino acid sequence of SEQ ID NO. 109 and a DVD light chain amino acid sequence of SEQ ID NO: 110.

In an embodiment, the binding protein capable of binding CD-20 and CD-22 comprises a DVD heavy chain amino acid sequence selected from the group consisting of SEQ ID NO. 111 and SEQ ID NO. 113; and a DVD light chain amino acid sequence selected from the group consisting of SEQ ID NO. 112 and SEQ ID NO. 114. In an embodiment, the binding protein capable of binding CD-20 and CD-22 comprises a DVD heavy chain amino acid sequence of SEQ ID NO. 111 and a DVD light chain amino acid sequence of SEQ ID NO: 112. In another embodiment, the binding protein capable of binding CD-20 and CD-22 has a reverse orientation and comprises a DVD heavy chain amino acid sequence of SEQ ID NO. 113 and a DVD light chain amino acid sequence of SEQ ID NO: 114.

In an embodiment, the binding protein capable of binding CD-20 and CD-40 comprises a DVD heavy chain amino acid sequence selected from the group consisting of SEQ ID NO. 115 and SEQ ID NO. 117; and a DVD light chain amino acid sequence selected from the group consisting of SEQ ID NO. 116 and SEQ ID NO. 118. In an embodiment, the binding protein capable of binding CD-20 and CD-40 comprises a DVD heavy chain amino acid sequence of SEQ ID NO. 115 and a DVD light chain amino acid sequence of SEQ ID NO: 116. In another embodiment, the binding protein capable of binding CD-20 and CD-40 has a reverse orientation and comprises a DVD heavy chain amino acid sequence of SEQ ID NO. 117 and a DVD light chain amino acid sequence of SEQ ID NO: 118.

In an embodiment, the binding protein capable of binding CD-3 (seq. 1) and HER-2 (seq. 1) comprises a DVD heavy chain amino acid sequence selected from the group consisting of SEQ ID NO. 119 and SEQ ID NO. 121; and a DVD light chain amino acid sequence selected from the group consisting of SEQ ID NO. 120 and SEQ ID NO. 122. In an embodiment, the binding protein capable of binding CD-3 (seq. 1) and HER-2 (seq. 1) comprises a DVD heavy chain amino acid sequence of SEQ ID NO. 119 and a DVD light chain amino acid sequence of SEQ ID NO: 120. In another embodiment, the binding protein capable of binding CD-3 (seq. 1) and HER-2 (seq. 1) has a reverse orientation and comprises a DVD heavy chain amino acid sequence of SEQ ID NO. 121 and a DVD light chain amino acid sequence of SEQ ID NO: 122.

In an embodiment, the binding protein capable of binding CD-3 (seq. 1) and CD-19 comprises a DVD heavy chain amino acid sequence selected from the group consisting of SEQ ID NO. 123 and SEQ ID NO. 125; and a DVD light chain amino acid sequence selected from the group consisting of SEQ ID NO. 124 and SEQ ID NO. 126. In an embodiment, the binding protein capable of binding CD-3 (seq. 1) and CD-19 comprises a DVD heavy chain amino acid sequence of SEQ ID NO. 123 and a DVD light chain amino acid sequence of SEQ ID NO: 124. In another embodiment, the binding protein capable of binding CD-3 (seq. 1) and CD-19 has a reverse orientation and comprises a DVD heavy chain amino acid sequence of SEQ ID NO. 125 and a DVD light chain amino acid sequence of SEQ ID NO: 126.

In an embodiment, the binding protein capable of binding EGFR (seq. 2) and HER-2 (seq. 1) comprises a DVD heavy chain amino acid sequence selected from the group consisting of SEQ ID NO. 127 and SEQ ID NO. 129; and a DVD light chain amino acid sequence selected from the group consisting of SEQ ID NO. 128 and SEQ ID NO. 130. In an embodiment, the binding protein capable of binding EGFR (seq. 2) and HER-2 (seq. 1) comprises a DVD heavy chain amino acid sequence of SEQ ID NO. 127 and a DVD light chain amino acid sequence of SEQ ID NO: 128. In another embodiment, the binding protein capable of binding EGFR (seq. 2) and HER-2 (seq. 1) has a reverse orientation and comprises a DVD heavy chain amino acid sequence of SEQ ID NO. 129 and a DVD light chain amino acid sequence of SEQ ID NO: 130.

In an embodiment, the binding protein capable of binding EGFR (seq. 2) and CD-3 (seq. 1) comprises a DVD heavy chain amino acid sequence selected from the group consisting of SEQ ID NO. 131 and SEQ ID NO. 133; and a DVD light chain amino acid sequence selected from the group consisting of SEQ ID NO. 132 and SEQ ID NO. 136. In an embodiment, the binding protein capable of binding EGFR (seq. 2) and CD-3 (seq. 1) comprises a DVD heavy chain amino acid sequence of SEQ ID NO. 131 and a DVD light chain amino acid sequence of SEQ ID NO: 132. In another embodiment, the binding protein capable of binding EGFR (seq. 1) and CD-3 (seq. 1) has a reverse orientation and comprises a DVD heavy chain amino acid sequence of SEQ ID NO. 133 and a DVD light chain amino acid sequence of SEQ ID NO: 134.

In an embodiment, the binding protein capable of binding EGFR (seq. 2) and IGF1,2 comprises a DVD heavy chain amino acid sequence selected from the group consisting of SEQ ID NO. 135 and SEQ ID NO. 137; and a DVD light chain amino acid sequence selected from the group consisting of SEQ ID NO. 136 and SEQ ID NO. 138. In an embodiment, the binding protein capable of binding EGFR (seq. 2) and IGF1,2 comprises a DVD heavy chain amino acid sequence of SEQ ID NO. 135 and a DVD light chain amino acid sequence of SEQ ID NO: 136. In another embodiment, the binding protein capable of binding EGFR (seq. 2) and IGF1,2 has a reverse orientation and comprises a DVD heavy chain amino acid sequence of SEQ ID NO. 137 and a DVD light chain amino acid sequence of SEQ ID NO: 138.

In an embodiment, the binding protein capable of binding EGFR (seq. 2) and IGF1R (seq. 1) comprises a DVD heavy chain amino acid sequence selected from the group consisting of SEQ ID NO. 139 and SEQ ID NO. 140; and a DVD light chain amino acid sequence selected from the group consisting of SEQ ID NO. 141 and SEQ ID NO. 142. In an embodiment, the binding protein capable of binding EGFR (seq. 2) and IGF1R (seq. 1) comprises a DVD heavy chain amino acid sequence of SEQ ID NO. 139 and a DVD light chain amino acid sequence of SEQ ID NO: 140. In another embodiment, the binding protein capable of binding EGFR (seq. 2) and IGF1R (seq. 1) has a reverse orientation and comprises a DVD heavy chain amino acid sequence of SEQ ID NO. 141 and a DVD light chain amino acid sequence of SEQ ID NO: 142.

In a second embodiment, the binding protein capable of binding EGFR (seq. 2) and IGF1R (seq. 1) comprises a DVD heavy chain amino acid sequence selected from the group consisting of SEQ ID NO. 143 and SEQ ID NO. 145; and a DVD light chain amino acid sequence selected from the group consisting of SEQ ID NO. 144 and SEQ ID NO. 146. In an embodiment, the binding protein capable of binding EGFR (seq. 2) and IGF1R (seq. 1) comprises a DVD heavy chain amino acid sequence of SEQ ID NO. 143 and a DVD light chain amino acid sequence of SEQ ID NO: 144. In another embodiment, the binding protein capable of binding EGFR (seq. 2) and IGF1R (seq. 1) has a reverse orientation and comprises a DVD heavy chain amino acid sequence of SEQ ID NO. 145 and a DVD light chain amino acid sequence of SEQ ID NO: 146.

In a third embodiment, the binding protein capable of binding EGFR (seq. 2) and IGF1R (seq. 1) comprises a DVD heavy chain amino acid sequence selected from the group consisting of SEQ ID NO. 147 and SEQ ID NO. 149; and a DVD light chain amino acid sequence selected from the group consisting of SEQ ID NO. 148 and SEQ ID NO. 150. In an embodiment, the binding protein capable of binding EGFR (seq. 2) and IGF1R (seq. 1) comprises a DVD heavy chain amino acid sequence of SEQ ID NO. 147 and a DVD light chain amino acid sequence of SEQ ID NO: 148. In another embodiment, the binding protein capable of binding EGFR (seq. 2) and IGF1R (seq. 1) has a reverse orientation and comprises a DVD heavy chain amino acid sequence of SEQ ID NO. 149 and a DVD light chain amino acid sequence of SEQ ID NO: 150.

In a fourth embodiment, the binding protein capable of binding EGFR (seq. 2) and IGF1R (seq. 1) comprises a DVD heavy chain amino acid sequence selected from the group consisting of SEQ ID NO. 151 and SEQ ID NO. 153; and a DVD light chain amino acid sequence selected from the group consisting of SEQ ID NO. 152 and SEQ ID NO. 154. In an embodiment, the binding protein capable of binding EGFR (seq. 2) and IGF1R (seq. 1) comprises a DVD heavy chain amino acid sequence of SEQ ID NO. 151 and a DVD light chain amino acid sequence of SEQ ID NO: 152. In another embodiment, the binding protein capable of binding EGFR (seq. 2) and IGF1R (seq. 1) has a reverse orientation and comprises a DVD heavy chain amino acid sequence of SEQ ID NO. 153 and a DVD light chain amino acid sequence of SEQ ID NO: 154.

In an embodiment, the binding protein capable of binding EGFR (seq. 2) and IGF1R (seq. 2) comprises a DVD heavy chain amino acid sequence selected from the group consisting of SEQ ID NO. 155 and SEQ ID NO. 157; and a DVD light chain amino acid sequence selected from the group consisting of SEQ ID NO. 156 and SEQ ID NO. 158. In an embodiment, the binding protein capable of binding EGFR (seq. 2) and IGF1R (seq. 2) comprises a DVD heavy chain amino acid sequence of SEQ ID NO. 155 and a DVD light chain amino acid sequence of SEQ ID NO: 156. In another embodiment, the binding protein capable of binding EGFR (seq. 2) and IGF1R (seq. 2) has a reverse orientation and comprises a DVD heavy chain amino acid sequence of SEQ ID NO. 157 and a DVD light chain amino acid sequence of SEQ ID NO: 158.

In a second embodiment, the binding protein capable of binding EGFR (seq. 2) and IGF1R (seq. 2) comprises a DVD heavy chain amino acid sequence selected from the group consisting of SEQ ID NO. 159 and SEQ ID NO. 161; and a DVD light chain amino acid sequence selected from the group consisting of SEQ ID NO. 160 and SEQ ID NO. 162. In an embodiment, the binding protein capable of binding EGFR (seq. 2) and IGF1R (seq. 2) comprises a DVD heavy chain amino acid sequence of SEQ ID NO. 159 and a DVD light chain amino acid sequence of SEQ ID NO: 160. In another embodiment, the binding protein capable of binding EGFR (seq. 2) and IGF1R (seq. 2) has a reverse orientation and comprises a DVD heavy chain amino acid sequence of SEQ ID NO. 161 and a DVD light chain amino acid sequence of SEQ ID NO: 162.

In a third embodiment, the binding protein capable of binding EGFR (seq. 2) and IGF1R (seq. 2) comprises a DVD heavy chain amino acid sequence selected from the group consisting of SEQ ID NO. 163 and SEQ ID NO. 165; and a DVD light chain amino acid sequence selected from the group consisting of SEQ ID NO. 164 and SEQ ID NO. 166. In an embodiment, the binding protein capable of binding EGFR (seq. 2) and IGF1R (seq. 2) comprises a DVD heavy chain amino acid sequence of SEQ ID NO. 163 and a DVD light chain amino acid sequence of SEQ ID NO: 164. In another embodiment, the binding protein capable of binding EGFR (seq. 2) and IGF1R (seq. 2) has a reverse orientation and comprises a DVD heavy chain amino acid sequence of SEQ ID NO. 165 and a DVD light chain amino acid sequence of SEQ ID NO: 166.

In a fourth embodiment, the binding protein capable of binding EGFR (seq. 2) and IGF1R (seq. 2) comprises a DVD heavy chain amino acid sequence selected from the group consisting of SEQ ID NO. 167 and SEQ ID NO. 169; and a DVD light chain amino acid sequence selected from the group consisting of SEQ ID NO. 168 and SEQ ID NO. 170. In an embodiment, the binding protein capable of binding EGFR (seq. 2) and IGF1R (seq. 2) comprises a DVD heavy chain amino acid sequence of SEQ ID NO. 167 and a DVD light chain amino acid sequence of SEQ ID NO: 168. In another embodiment, the binding protein capable of binding EGFR (seq. 2) and IGF1R (seq. 2) has a reverse orientation and comprises a DVD heavy chain amino acid sequence of SEQ ID NO. 169 and a DVD light chain amino acid sequence of SEQ ID NO: 170.

In an embodiment, the binding protein capable of binding EGFR (seq. 2) and IGF1R (seq. 3) comprises a DVD heavy chain amino acid sequence selected from the group consisting of SEQ ID NO. 171 and SEQ ID NO. 173; and a DVD light chain amino acid sequence selected from the group consisting of SEQ ID NO. 172 and SEQ ID NO. 174. In an embodiment, the binding protein capable of binding EGFR (seq. 2) and IGF1R (seq. 3) comprises a DVD heavy chain amino acid sequence of SEQ ID NO. 171 and a DVD light chain amino acid sequence of SEQ ID NO: 172. In another embodiment, the binding protein capable of binding EGFR (seq. 2) and IGF1R (seq. 3) has a reverse orientation and comprises a DVD heavy chain amino acid sequence of SEQ ID NO. 173 and a DVD light chain amino acid sequence of SEQ ID NO: 174.

In a second embodiment, the binding protein capable of binding EGFR (seq. 2) and IGF1R (seq. 3) comprises a DVD heavy chain amino acid sequence selected from the group consisting of SEQ ID NO. 175 and SEQ ID NO. 177; and a DVD light chain amino acid sequence selected from the group consisting of SEQ ID NO. 176 and SEQ ID NO. 178. In an embodiment, the binding protein capable of binding EGFR (seq. 2) and IGF1R (seq. 3) comprises a DVD heavy chain amino acid sequence of SEQ ID NO. 175 and a DVD light chain amino acid sequence of SEQ ID NO: 176. In another embodiment, the binding protein capable of binding EGFR (seq. 2) and IGF1R (seq. 3) has a reverse orientation and comprises a DVD heavy chain amino acid sequence of SEQ ID NO. 177 and a DVD light chain amino acid sequence of SEQ ID NO: 178.

In a third embodiment, the binding protein capable of binding EGFR (seq. 2) and IGF1R (seq. 3) comprises a DVD heavy chain amino acid sequence selected from the group consisting of SEQ ID NO. 179 and SEQ ID NO. 181; and a DVD light chain amino acid sequence selected from the group consisting of SEQ ID NO. 180 and SEQ ID NO. 182. In an embodiment, the binding protein capable of binding EGFR (seq. 2) and IGF1R (seq. 3) comprises a DVD heavy chain amino acid sequence of SEQ ID NO. 179 and a DVD light chain amino acid sequence of SEQ ID NO: 180. In another embodiment, the binding protein capable of binding EGFR (seq. 2) and IGF1R (seq. 3) has a reverse orientation and comprises a DVD heavy chain amino acid sequence of SEQ ID NO. 181 and a DVD light chain amino acid sequence of SEQ ID NO: 182.

In a fourth embodiment, the binding protein capable of binding EGFR (seq. 2) and IGF1R (seq. 3) comprises a DVD heavy chain amino acid sequence selected from the group consisting of SEQ ID NO. 183 and SEQ ID NO. 185; and a DVD light chain amino acid sequence selected from the group consisting of SEQ ID NO. 184 and SEQ ID NO. 186. In an embodiment, the binding protein capable of binding EGFR (seq. 2) and IGF1R (seq. 3) comprises a DVD heavy chain amino acid sequence of SEQ ID NO. 183 and a DVD light chain amino acid sequence of SEQ ID NO: 184. In another embodiment, the binding protein capable of binding EGFR (seq. 2) and IGF1R (seq. 3) has a reverse orientation and comprises a DVD heavy chain amino acid sequence of SEQ ID NO. 185 and a DVD light chain amino acid sequence of SEQ ID NO: 186.

In an embodiment, the binding protein capable of binding EGFR (seq. 2) and RON (seq. 1) comprises a DVD heavy chain amino acid sequence selected from the group consisting of SEQ ID NO. 187 and SEQ ID NO. 189; and a DVD light chain amino acid sequence selected from the group consisting of SEQ ID NO. 188 and SEQ ID NO. 190. In an embodiment, the binding protein capable of binding EGFR (seq. 2) and RON (seq. 1) comprises a DVD heavy chain amino acid sequence of SEQ ID NO. 187 and a DVD light chain amino acid sequence of SEQ ID NO: 188. In another embodiment, the binding protein capable of binding EGFR (seq. 2) and RON (seq. 1) has a reverse orientation and comprises a DVD heavy chain amino acid sequence of SEQ ID NO. 189 and a DVD light chain amino acid sequence of SEQ ID NO: 190.

In a second embodiment, the binding protein capable of binding EGFR (seq. 2) and RON (seq. 1) comprises a DVD heavy chain amino acid sequence selected from the group consisting of SEQ ID NO. 191 and SEQ ID NO. 193; and a DVD light chain amino acid sequence selected from the group consisting of SEQ ID NO. 192 and SEQ ID NO. 194. In an embodiment, the binding protein capable of binding EGFR (seq. 2) and RON (seq. 1) comprises a DVD heavy chain amino acid sequence of SEQ ID NO. 191 and a DVD light chain amino acid sequence of SEQ ID NO: 192. In another embodiment, the binding protein capable of binding EGFR (seq. 2) and RON (seq. 1) has a reverse orientation and comprises a DVD heavy chain amino acid sequence of SEQ ID NO. 193 and a DVD light chain amino acid sequence of SEQ ID NO: 194.

In a third embodiment, the binding protein capable of binding EGFR (seq. 2) and RON (seq. 1) comprises a DVD heavy chain amino acid sequence selected from the group consisting of SEQ ID NO. 195 and SEQ ID NO. 197; and a DVD light chain amino acid sequence selected from the group consisting of SEQ ID NO. 196 and SEQ ID NO. 198. In an embodiment, the binding protein capable of binding EGFR (seq. 2) and RON (seq. 1) comprises a DVD heavy chain amino acid sequence of SEQ ID NO. 195 and a DVD light chain amino acid sequence of SEQ ID NO: 196. In another embodiment, the binding protein capable of binding EGFR (seq. 2) and RON (seq. 1) has a reverse orientation and comprises a DVD heavy chain amino acid sequence of SEQ ID NO. 197 and a DVD light chain amino acid sequence of SEQ ID NO: 198.

In a fourth embodiment, the binding protein capable of binding EGFR (seq. 2) and RON (seq. 1) comprises a DVD heavy chain amino acid sequence selected from the group consisting of SEQ ID NO. 199 and SEQ ID NO. 201; and a DVD light chain amino acid sequence selected from the group consisting of SEQ ID NO. 200 and SEQ ID NO. 202. In an embodiment, the binding protein capable of binding EGFR (seq. 2) and RON (seq. 1) comprises a DVD heavy chain amino acid sequence of SEQ ID NO. 199 and a DVD light chain amino acid sequence of SEQ ID NO: 200. In another embodiment, the binding protein capable of binding EGFR (seq. 2) and RON (seq. 1) has a reverse orientation and comprises a DVD heavy chain amino acid sequence of SEQ ID NO. 201 and a DVD light chain amino acid sequence of SEQ ID NO: 202.

In an embodiment, the binding protein capable of binding EGFR (seq. 2) and HGF (seq. 1) comprises a DVD heavy chain amino acid sequence selected from the group consisting of SEQ ID NO. 203 and SEQ ID NO. 205; and a DVD light chain amino acid sequence selected from the group consisting of SEQ ID NO. 204 and SEQ ID NO. 206. In an embodiment, the binding protein capable of binding EGFR (seq. 2) and HGF (seq. 1) comprises a DVD heavy chain amino acid sequence of SEQ ID NO. 203 and a DVD light chain amino acid sequence of SEQ ID NO: 204. In another embodiment, the binding protein capable of binding EGFR (seq. 2) and HGF (seq. 1) has a reverse orientation and comprises a DVD heavy chain amino acid sequence of SEQ ID NO. 205 and a DVD light chain amino acid sequence of SEQ ID NO: 206.

In an embodiment, the binding protein capable of binding EGFR (seq. 1) and c-MET comprises a DVD heavy chain amino acid sequence selected from the group consisting of SEQ ID NO. 207 and SEQ ID NO. 209; and a DVD light chain amino acid sequence selected from the group consisting of SEQ ID NO. 208 and SEQ ID NO. 210. In an embodiment, the binding protein capable of binding EGFR (seq. 1) and c-MET comprises a DVD heavy chain amino acid sequence of SEQ ID NO. 207 and a DVD light chain amino acid sequence of SEQ ID NO: 208. In another embodiment, the binding protein capable of binding EGFR (seq. 1) and c-MET has a reverse orientation and comprises a DVD heavy chain amino acid sequence of SEQ ID NO. 209 and a DVD light chain amino acid sequence of SEQ ID NO: 210.

In an embodiment, the binding protein capable of binding HER-2 (seq. 1) and IGF1,2 comprises a DVD heavy chain amino acid sequence selected from the group consisting of SEQ ID NO. 211 and SEQ ID NO. 213; and a DVD light chain amino acid sequence selected from the group consisting of SEQ ID NO. 212 and SEQ ID NO. 214. In an embodiment, the binding protein capable of binding HER-2 (seq. 1) and IGF1,2 comprises a DVD heavy chain amino acid sequence of SEQ ID NO. 211 and a DVD light chain amino acid sequence of SEQ ID NO: 212. In another embodiment, the binding protein capable of binding HER-2 (seq. 1) and IGF1,2 has a reverse orientation and comprises a DVD heavy chain amino acid sequence of SEQ ID NO. 213 and a DVD light chain amino acid sequence of SEQ ID NO: 214.

In an embodiment, the binding protein capable of binding HER-2 (seq. 1) and IGF1R comprises a DVD heavy chain amino acid sequence selected from the group consisting of SEQ ID NO. 215 and SEQ ID NO. 217; and a DVD light chain amino acid sequence selected from the group consisting of SEQ ID NO. 216 and SEQ ID NO. 218. In an embodiment, the binding protein capable of binding HER-2 (seq. 1) and IGF1R comprises a DVD heavy chain amino acid sequence of SEQ ID NO. 215 and a DVD light chain amino acid sequence of SEQ ID NO: 216. In another embodiment, the binding protein capable of binding HER-2 (seq. 1) and IGF1R has a reverse orientation and comprises a DVD heavy chain amino acid sequence of SEQ ID NO. 217 and a DVD light chain amino acid sequence of SEQ ID NO: 218.

In an embodiment, the binding protein capable of binding RON (seq. 1) and HGF (seq. 1) comprises a DVD heavy chain amino acid sequence selected from the group consisting of SEQ ID NO. 219 and SEQ ID NO. 221; and a DVD light chain amino acid sequence selected from the group consisting of SEQ ID NO. 220 and SEQ ID NO. 222. In an embodiment, the binding protein capable of binding RON (seq. 1) and HGF (seq. 1) comprises a DVD heavy chain amino acid sequence of SEQ ID NO. 219 and a DVD light chain amino acid sequence of SEQ ID NO: 220. In another embodiment, the binding protein capable of binding RON (seq. 1) and HGF (seq. 1) has a reverse orientation and comprises a DVD heavy chain amino acid sequence of SEQ ID NO. 221 and a DVD light chain amino acid sequence of SEQ ID NO: 222.

In an embodiment, the binding protein capable of binding VEGF (seq. 1) and EGFR (seq. 2) comprises a DVD heavy chain amino acid sequence selected from the group consisting of SEQ ID NO. 223 and SEQ ID NO. 225; and a DVD light chain amino acid sequence selected from the group consisting of SEQ ID NO. 224 and SEQ ID NO. 226. In an embodiment, the binding protein capable of binding VEGF (seq. 1) and EGFR (seq. 2) comprises a DVD heavy chain amino acid sequence of SEQ ID NO. 223 and a DVD light chain amino acid sequence of SEQ ID NO: 224. In another embodiment, the binding protein capable of binding VEGF (seq. 1) and EGFR (seq. 2) has a reverse orientation and comprises a DVD heavy chain amino acid sequence of SEQ ID NO. 225 and a DVD light chain amino acid sequence of SEQ ID NO: 226.

In an embodiment, the binding protein capable of binding VEGF (seq. 1) and HER-2 (seq. 1) comprises a DVD heavy chain amino acid sequence selected from the group consisting of SEQ ID NO. 227 and SEQ ID NO. 229; and a DVD light chain amino acid sequence selected from the group consisting of SEQ ID NO. 228 and SEQ ID NO. 230. In an embodiment, the binding protein capable of binding VEGF (seq. 1) and HER-2 (seq. 1) comprises a DVD heavy chain amino acid sequence of SEQ ID NO. 227 and a DVD light chain amino acid sequence of SEQ ID NO: 228. In another embodiment, the binding protein capable of binding VEGF (seq. 1) and HER-2 (seq. 1) has a reverse orientation and comprises a DVD heavy chain amino acid sequence of SEQ ID NO. 229 and a DVD light chain amino acid sequence of SEQ ID NO: 230.

In an embodiment, the binding protein capable of binding VEGF (seq. 1) and CD-20 comprises a DVD heavy chain amino acid sequence selected from the group consisting of SEQ ID NO. 231 and SEQ ID NO. 233; and a DVD light chain amino acid sequence selected from the group consisting of SEQ ID NO. 232 and SEQ ID NO. 234. In an embodiment, the binding protein capable of binding VEGF (seq. 1) and CD-20 comprises a DVD heavy chain amino acid sequence of SEQ ID NO. 231 and a DVD light chain amino acid sequence of SEQ ID NO: 232. In another embodiment, the binding protein capable of binding VEGF (seq. 1) and CD-20 has a reverse orientation and comprises a DVD heavy chain amino acid sequence of SEQ ID NO. 233 and a DVD light chain amino acid sequence of SEQ ID NO: 234.

In an embodiment, the binding protein capable of binding VEGF (seq. 1) and IGF1,2 comprises a DVD heavy chain amino acid sequence selected from the group consisting of SEQ ID NO. 235 and SEQ ID NO. 237; and a DVD light chain amino acid sequence selected from the group consisting of SEQ ID NO. 236 and SEQ ID NO. 238. In an embodiment, the binding protein capable of binding VEGF (seq. 1) and IGF1,2 comprises a DVD heavy chain amino acid sequence of SEQ ID NO. 235 and a DVD light chain amino acid sequence of SEQ ID NO: 236. In another embodiment, the binding protein capable of binding VEGF (seq. 1) and IGF1,2 has a reverse orientation and comprises a DVD heavy chain amino acid sequence of SEQ ID NO. 237 and a DVD light chain amino acid sequence of SEQ ID NO: 238.

In an embodiment, the binding protein capable of binding VEGF (seq. 1) and DLL-4 (seq. 1) comprises a DVD heavy chain amino acid sequence selected from the group consisting of SEQ ID NO. 239 and SEQ ID NO. 241; and a DVD light chain amino acid sequence selected from the group consisting of SEQ ID NO. 240 and SEQ ID NO. 242. In an embodiment, the binding protein capable of binding VEGF (seq. 1) and DLL-4 (seq. 1) comprises a DVD heavy chain amino acid sequence of SEQ ID NO. 239 and a DVD light chain amino acid sequence of SEQ ID NO: 240. In another embodiment, the binding protein capable of binding VEGF (seq. 1) and DLL-4 (seq. 1) has a reverse orientation and comprises a DVD heavy chain amino acid sequence of SEQ ID NO. 241 and a DVD light chain amino acid sequence of SEQ ID NO: 242.

In an embodiment, the binding protein capable of binding VEGF (seq. 1) and HGF (seq. 1) comprises a DVD heavy chain amino acid sequence selected from the group consisting of SEQ ID NO. 243 and SEQ ID NO. 245; and a DVD light chain amino acid sequence selected from the group consisting of SEQ ID NO. 244 and SEQ ID NO. 246. In an embodiment, the binding protein capable of binding VEGF (seq. 1) and HGF (seq. 1) comprises a DVD heavy chain amino acid sequence of SEQ ID NO. 243 and a DVD light chain amino acid sequence of SEQ ID NO: 244. In another embodiment, the binding protein capable of binding VEGF (seq. 1) and HGF (seq. 1) has a reverse orientation and comprises a DVD heavy chain amino acid sequence of SEQ ID NO. 245 and a DVD light chain amino acid sequence of SEQ ID NO: 246.

In a second embodiment, the binding protein capable of binding VEGF (seq. 1) and HGF (seq. 1) comprises a DVD heavy chain amino acid sequence selected from the group consisting of SEQ ID NO. 247 and SEQ ID NO. 249; and a DVD light chain amino acid sequence selected from the group consisting of SEQ ID NO. 248 and SEQ ID NO. 250. In an embodiment, the binding protein capable of binding VEGF (seq. 1) and HGF (seq. 1) comprises a DVD heavy chain amino acid sequence of SEQ ID NO. 247 and a DVD light chain amino acid sequence of SEQ ID NO: 248. In another embodiment, the binding protein capable of binding VEGF (seq. 1) and HGF (seq. 1) has a reverse orientation and comprises a DVD heavy chain amino acid sequence of SEQ ID NO. 249 and a DVD light chain amino acid sequence of SEQ ID NO: 250.

In a third embodiment, the binding protein capable of binding VEGF (seq. 1) and HGF (seq. 1) comprises a DVD heavy chain amino acid sequence selected from the group consisting of SEQ ID NO. 251 and SEQ ID NO. 253; and a DVD light chain amino acid sequence selected from the group consisting of SEQ ID NO. 252 and SEQ ID NO. 254. In an embodiment, the binding protein capable of binding VEGF (seq. 1) and HGF (seq. 1) comprises a DVD heavy chain amino acid sequence of SEQ ID NO. 251 and a DVD light chain amino acid sequence of SEQ ID NO: 252. In another embodiment, the binding protein capable of binding VEGF (seq. 1) and HGF (seq. 1) has a reverse orientation and comprises a DVD heavy chain amino acid sequence of SEQ ID NO. 253 and a DVD light chain amino acid sequence of SEQ ID NO: 254.

In a fourth embodiment, the binding protein capable of binding VEGF (seq. 1) and HGF (seq. 1) comprises a DVD heavy chain amino acid sequence selected from the group consisting of SEQ ID NO. 255 and SEQ ID NO. 257; and a DVD light chain amino acid sequence selected from the group consisting of SEQ ID NO. 256 and SEQ ID NO. 258. In an embodiment, the binding protein capable of binding VEGF (seq. 1) and HGF (seq. 1) comprises a DVD heavy chain amino acid sequence of SEQ ID NO. 255 and a DVD light chain amino acid sequence of SEQ ID NO: 256. In another embodiment, the binding protein capable of binding VEGF (seq. 1) and HGF (seq. 1) has a reverse orientation and comprises a DVD heavy chain amino acid sequence of SEQ ID NO. 257 and a DVD light chain amino acid sequence of SEQ ID NO: 258.

In an embodiment, the binding protein capable of binding VEGF (seq. 1) and RON (seq. 1) comprises a DVD heavy chain amino acid sequence selected from the group consisting of SEQ ID NO. 259 and SEQ ID NO. 261; and a DVD light chain amino acid sequence selected from the group consisting of SEQ ID NO. 260 and SEQ ID NO. 262. In an embodiment, the binding protein capable of binding VEGF (seq. 1) and RON (seq. 1) comprises a DVD heavy chain amino acid sequence of SEQ ID NO. 259 and a DVD light chain amino acid sequence of SEQ ID NO: 260. In another embodiment, the binding protein capable of binding VEGF (seq. 1) and RON (seq. 1) has a reverse orientation and comprises a DVD heavy chain amino acid sequence of SEQ ID NO. 261 and a DVD light chain amino acid sequence of SEQ ID NO: 262.

In an embodiment, the binding protein capable of binding VEGF (seq. 1) and NRP1 (seq. 1) comprises a DVD heavy chain amino acid sequence selected from the group consisting of SEQ ID NO. 263 and SEQ ID NO. 265; and a DVD light chain amino acid sequence selected from the group consisting of SEQ ID NO. 264 and SEQ ID NO. 266. In an embodiment, the binding protein capable of binding VEGF (seq. 1) and NRP1 (seq. 1) comprises a DVD heavy chain amino acid sequence of SEQ ID NO. 263 and a DVD light chain amino acid sequence of SEQ ID NO: 264. In another embodiment, the binding protein capable of binding VEGF (seq. 1) and NRP1 (seq. 1) has a reverse orientation and comprises a DVD heavy chain amino acid sequence of SEQ ID NO. 265 and a DVD light chain amino acid sequence of SEQ ID NO: 266.

In an embodiment, the binding protein capable of binding RON (seq. 2) and HGF (seq. 1) comprises a DVD heavy chain amino acid sequence selected from the group consisting of SEQ ID NO. 267 and SEQ ID NO. 269; and a DVD light chain amino acid sequence selected from the group consisting of SEQ ID NO. 268 and SEQ ID NO. 270. In an embodiment, the binding protein capable of binding RON (seq. 2) and HGF (seq. 1) comprises a DVD heavy chain amino acid sequence of SEQ ID NO. 267 and a DVD light chain amino acid sequence of SEQ ID NO: 268. In another embodiment, the binding protein capable of binding RON (seq. 2) and HGF (seq. 1) has a reverse orientation and comprises a DVD heavy chain amino acid sequence of SEQ ID NO. 269 and a DVD light chain amino acid sequence of SEQ ID NO: 270.

In an embodiment, the binding protein capable of binding RON (seq. 2) and EGFR (seq. 2) comprises a DVD heavy chain amino acid sequence selected from the group consisting of SEQ ID NO. 271 and SEQ ID NO. 273; and a DVD light chain amino acid sequence selected from the group consisting of SEQ ID NO. 272 and SEQ ID NO. 274. In an embodiment, the binding protein capable of binding RON (seq. 2) and EGFR (seq. 2) comprises a DVD heavy chain amino acid sequence of SEQ ID NO. 271 and a DVD light chain amino acid sequence of SEQ ID NO: 272. In another embodiment, the binding protein capable of binding RON (seq. 2) and EGFR (seq. 2) has a reverse orientation and comprises a DVD heavy chain amino acid sequence of SEQ ID NO. 273 and a DVD light chain amino acid sequence of SEQ ID NO: 274.

In an embodiment, the binding protein capable of binding RON (seq. 2) and VEGF (seq. 1) comprises a DVD heavy chain amino acid sequence selected from the group consisting of SEQ ID NO. 275 and SEQ ID NO. 277; and a DVD light chain amino acid sequence selected from the group consisting of SEQ ID NO. 276 and SEQ ID NO. 278. In an embodiment, the binding protein capable of binding RON (seq. 2) and VEGF (seq. 1) comprises a DVD heavy chain amino acid sequence of SEQ ID NO. 275 and a DVD light chain amino acid sequence of SEQ ID NO: 276. In another embodiment, the binding protein capable of binding RON (seq. 2) and VEGF (seq. 1) has a reverse orientation and comprises a DVD heavy chain amino acid sequence of SEQ ID NO. 277 and a DVD light chain amino acid sequence of SEQ ID NO: 278.

In an embodiment, the binding protein capable of binding EGFR (seq. 1) and HER-2 (seq. 1) comprises a DVD heavy chain amino acid sequence selected from the group consisting of SEQ ID NO. 279 and SEQ ID NO. 281; and a DVD light chain amino acid sequence selected from the group consisting of SEQ ID NO. 280 and SEQ ID NO. 282. In an embodiment, the binding protein capable of binding EGFR (seq. 1) and HER-2 (seq. 1) comprises a DVD heavy chain amino acid sequence of SEQ ID NO. 279 and a DVD light chain amino acid sequence of SEQ ID NO: 280. In another embodiment, the binding protein capable of binding EGFR (seq. 1) and HER-2 (seq. 1) has a reverse orientation and comprises a DVD heavy chain amino acid sequence of SEQ ID NO. 281 and a DVD light chain amino acid sequence of SEQ ID NO: 282.

In an embodiment, the binding protein capable of binding EGFR (seq. 1) and CD-3 (seq. 1) comprises a DVD heavy chain amino acid sequence selected from the group consisting of SEQ ID NO. 283 and SEQ ID NO. 285; and a DVD light chain amino acid sequence selected from the group consisting of SEQ ID NO. 284 and SEQ ID NO. 286. In an embodiment, the binding protein capable of binding EGFR (seq. 1) and CD-3 (seq. 1) comprises a DVD heavy chain amino acid sequence of SEQ ID NO. 283 and a DVD light chain amino acid sequence of SEQ ID NO: 284. In another embodiment, the binding protein capable of binding EGFR (seq. 1) and CD-3 (seq. 1) has a reverse orientation and comprises a DVD heavy chain amino acid sequence of SEQ ID NO. 285 and a DVD light chain amino acid sequence of SEQ ID NO: 286.

In an embodiment, the binding protein capable of binding EGFR (seq. 1) and IGF1R comprises a DVD heavy chain amino acid sequence selected from the group consisting of SEQ ID NO. 287 and SEQ ID NO. 289; and a DVD light chain amino acid sequence selected from the group consisting of SEQ ID NO. 288 and SEQ ID NO. 290. In an embodiment, the binding protein capable of binding EGFR (seq. 1) and IGF1R comprises a DVD heavy chain amino acid sequence of SEQ ID NO. 287 and a DVD light chain amino acid sequence of SEQ ID NO: 288. In another embodiment, the binding protein capable of binding EGFR (seq. 1) and IGF1R has a reverse orientation and comprises a DVD heavy chain amino acid sequence of SEQ ID NO. 289 and a DVD light chain amino acid sequence of SEQ ID NO: 290.

In an embodiment, the binding protein capable of binding EGFR (seq. 1) and RON (seq. 1) comprises a DVD heavy chain amino acid sequence selected from the group consisting of SEQ ID NO. 291 and SEQ ID NO. 293; and a DVD light chain amino acid sequence selected from the group consisting of SEQ ID NO. 292 and SEQ ID NO. 294. In an embodiment, the binding protein capable of binding EGFR (seq. 1) and RON (seq. 1) comprises a DVD heavy chain amino acid sequence of SEQ ID NO. 291 and a DVD light chain amino acid sequence of SEQ ID NO: 292. In another embodiment, the binding protein capable of binding EGFR (seq. 1) and RON (seq. 1) has a reverse orientation and comprises a DVD heavy chain amino acid sequence of SEQ ID NO. 293 and a DVD light chain amino acid sequence of SEQ ID NO: 294.

In an embodiment, the binding protein capable of binding EGFR (seq. 1) and RON (seq. 2) comprises a DVD heavy chain amino acid sequence selected from the group consisting of SEQ ID NO. 295 and SEQ ID NO. 297; and a DVD light chain amino acid sequence selected from the group consisting of SEQ ID NO. 296 and SEQ ID NO. 298. In an embodiment, the binding protein capable of binding EGFR (seq. 1) and RON (seq. 2) comprises a DVD heavy chain amino acid sequence of SEQ ID NO. 295 and a DVD light chain amino acid sequence of SEQ ID NO: 296. In another embodiment, the binding protein capable of binding EGFR (seq. 1) and RON (seq. 2) has a reverse orientation and comprises a DVD heavy chain amino acid sequence of SEQ ID NO. 297 and a DVD light chain amino acid sequence of SEQ ID NO: 298.

In an embodiment, the binding protein capable of binding EGFR (seq. 1) and HGF (seq. 1) comprises a DVD heavy chain amino acid sequence selected from the group consisting of SEQ ID NO. 299 and SEQ ID NO. 301; and a DVD light chain amino acid sequence selected from the group consisting of SEQ ID NO. 300 and SEQ ID NO. 302. In an embodiment, the binding protein capable of binding EGFR (seq. 1) and HGF (seq. 1) comprises a DVD heavy chain amino acid sequence of SEQ ID NO. 299 and a DVD light chain amino acid sequence of SEQ ID NO: 300. In another embodiment, the binding protein capable of binding EGFR (seq. 1) and HGF (seq. 1) has a reverse orientation and comprises a DVD heavy chain amino acid sequence of SEQ ID NO. 301 and a DVD light chain amino acid sequence of SEQ ID NO: 302.

In an embodiment, the binding protein capable of binding EGFR (seq. 1) and c-MET comprises a DVD heavy chain amino acid sequence selected from the group consisting of SEQ ID NO. 303 and SEQ ID NO. 305; and a DVD light chain amino acid sequence selected from the group consisting of SEQ ID NO. 304 and SEQ ID NO. 306. In an embodiment, the binding protein capable of binding EGFR (seq. 1) and c-MET comprises a DVD heavy chain amino acid sequence of SEQ ID NO. 303 and a DVD light chain amino acid sequence of SEQ ID NO: 304. In another embodiment, the binding protein capable of binding EGFR (seq. 1 and c-MET has a reverse orientation and comprises a DVD heavy chain amino acid sequence of SEQ ID NO. 305 and a DVD light chain amino acid sequence of SEQ ID NO: 306.

In an embodiment, the binding protein capable of binding EGFR (seq. 1) and VEGF (seq. 1) comprises a DVD heavy chain amino acid sequence selected from the group consisting of SEQ ID NO. 307 and SEQ ID NO. 309; and a DVD light chain amino acid sequence selected from the group consisting of SEQ ID NO. 308 and SEQ ID NO. 310. In an embodiment, the binding protein capable of binding EGFR (seq. 1) and VEGF (seq. 1) comprises a DVD heavy chain amino acid sequence of SEQ ID NO. 307 and a DVD light chain amino acid sequence of SEQ ID NO: 308. In another embodiment, the binding protein capable of binding EGFR (seq. 1) and VEGF (seq. 1) has a reverse orientation and comprises a DVD heavy chain amino acid sequence of SEQ ID NO. 309 and a DVD light chain amino acid sequence of SEQ ID NO: 310.

In an embodiment, the binding protein capable of binding NRP1 (seq. 2) and VEGF (seq. 1) comprises a DVD heavy chain amino acid sequence selected from the group consisting of SEQ ID NO. 311 and SEQ ID NO. 313; and a DVD light chain amino acid sequence selected from the group consisting of SEQ ID NO. 312 and SEQ ID NO. 314. In an embodiment, the binding protein capable of binding NRP1 (seq. 2) and VEGF (seq. 1) comprises a DVD heavy chain amino acid sequence of SEQ ID NO. 311 and a DVD light chain amino acid sequence of SEQ ID NO: 312. In another embodiment, the binding protein capable of binding NRP1 (seq. 2) and VEGF (seq. 1) has a reverse orientation and comprises a DVD heavy chain amino acid sequence of SEQ ID NO. 313 and a DVD light chain amino acid sequence of SEQ ID NO: 314.

In an embodiment, the binding protein capable of binding CD-3 (seq. 2) and CD-20 comprises a DVD heavy chain amino acid sequence selected from the group consisting of SEQ ID NO. 315 and SEQ ID NO. 317; and a DVD light chain amino acid sequence selected from the group consisting of SEQ ID NO. 316 and SEQ ID NO. 318. In an embodiment, the binding protein capable of binding CD-3 (seq. 2) and CD-20 comprises a DVD heavy chain amino acid sequence of SEQ ID NO. 315 and a DVD light chain amino acid sequence of SEQ ID NO: 316. In another embodiment, the binding protein capable of binding CD-3 (seq. 2) and CD-20 has a reverse orientation and comprises a DVD heavy chain amino acid sequence of SEQ ID NO. 317 and a DVD light chain amino acid sequence of SEQ ID NO: 318.

In an embodiment, the binding protein capable of binding CD-3 (seq. 2) and HER-2 (seq. 1) comprises a DVD heavy chain amino acid sequence selected from the group consisting of SEQ ID NO. 319 and SEQ ID NO. 321; and a DVD light chain amino acid sequence selected from the group consisting of SEQ ID NO. 320 and SEQ ID NO. 322. In an embodiment, the binding protein capable of binding CD-3 (seq. 2) and HER-2 (seq. 1) comprises a DVD heavy chain amino acid sequence of SEQ ID NO. 319 and a DVD light chain amino acid sequence of SEQ ID NO: 320. In another embodiment, the binding protein capable of binding CD-3 (seq. 2) and HER-2 (seq. 1) has a reverse orientation and comprises a DVD heavy chain amino acid sequence of SEQ ID NO. 321 and a DVD light chain amino acid sequence of SEQ ID NO: 322.

In an embodiment, the binding protein capable of binding CD-3 (seq. 2) and CD-19 comprises a DVD heavy chain amino acid sequence selected from the group consisting of SEQ ID NO. 323 and SEQ ID NO. 325; and a DVD light chain amino acid sequence selected from the group consisting of SEQ ID NO. 324 and SEQ ID NO. 326. In an embodiment, the binding protein capable of binding CD-3 (seq. 2) and CD-19 comprises a DVD heavy chain amino acid sequence of SEQ ID NO. 323 and a DVD light chain amino acid sequence of SEQ ID NO: 324. In another embodiment, the binding protein capable of binding CD-3 (seq. 2) and CD-19 has a reverse orientation and comprises a DVD heavy chain amino acid sequence of SEQ ID NO. 325 and a DVD light chain amino acid sequence of SEQ ID NO: 326.

In an embodiment, the binding protein capable of binding CD-3 (seq. 2) and EGFR (seq. 2) comprises a DVD heavy chain amino acid sequence selected from the group consisting of SEQ ID NO. 327 and SEQ ID NO. 329; and a DVD light chain amino acid sequence selected from the group consisting of SEQ ID NO. 328 and SEQ ID NO. 330. In an embodiment, the binding protein capable of binding CD-3 (seq. 2) and EGFR (seq. 2) comprises a DVD heavy chain amino acid sequence of SEQ ID NO. 327 and a DVD light chain amino acid sequence of SEQ ID NO: 328. In another embodiment, the binding protein capable of binding CD-3 (seq. 2) and EGFR (seq. 2) has a reverse orientation and comprises a DVD heavy chain amino acid sequence of SEQ ID NO. 329 and a DVD light chain amino acid sequence of SEQ ID NO: 330.

In an embodiment, the binding protein capable of binding CD-3 (seq. 2) and EGFR (seq. 1) comprises a DVD heavy chain amino acid sequence selected from the group consisting of SEQ ID NO. 331 and SEQ ID NO. 333; and a DVD light chain amino acid sequence selected from the group consisting of SEQ ID NO. 332 and SEQ ID NO. 334. In an embodiment, the binding protein capable of binding CD-3 (seq. 2) and EGFR (seq. 1) comprises a DVD heavy chain amino acid sequence of SEQ ID NO. 331 and a DVD light chain amino acid sequence of SEQ ID NO: 332. In another embodiment, the binding protein capable of binding CD-3 (seq. 2) and EGFR (seq. 1) has a reverse orientation and comprises a DVD heavy chain amino acid sequence of SEQ ID NO. 333 and a DVD light chain amino acid sequence of SEQ ID NO: 334.

In an embodiment, the binding protein capable of binding EGFR (seq. 1) and IGF1,2 comprises a DVD heavy chain amino acid sequence selected from the group consisting of SEQ ID NO. 335 and SEQ ID NO. 337; and a DVD light chain amino acid sequence selected from the group consisting of SEQ ID NO. 336 and SEQ ID NO. 338. In an embodiment, the binding protein capable of binding EGFR (seq. 1) and IGF1,2 comprises a DVD heavy chain amino acid sequence of SEQ ID NO. 335 and a DVD light chain amino acid sequence of SEQ ID NO: 336. In another embodiment, the binding protein capable of binding EGFR (seq. 1) and IGF1,2 has a reverse orientation and comprises a DVD heavy chain amino acid sequence of SEQ ID NO. 337 and a DVD light chain amino acid sequence of SEQ ID NO: 338.

In an embodiment, the binding protein capable of binding DLL-4 (seq. 1) and PLGF (seq. 1) comprises a DVD heavy chain amino acid sequence selected from the group consisting of SEQ ID NO. 339 and SEQ ID NO. 341; and a DVD light chain amino acid sequence selected from the group consisting of SEQ ID NO. 340 and SEQ ID NO. 342. In an embodiment, the binding protein capable of binding DLL-4 (seq. 1) and PLGF (seq. 1) comprises a DVD heavy chain amino acid sequence of SEQ ID NO. 339 and a DVD light chain amino acid sequence of SEQ ID NO: 340. In another embodiment, the binding protein capable of binding DLL-4 (seq. 1) and PLGF (seq. 1) has a reverse orientation and comprises a DVD heavy chain amino acid sequence of SEQ ID NO. 341 and a DVD light chain amino acid sequence of SEQ ID NO: 342.

In an embodiment, the binding protein capable of binding VEGF (seq. 1) and PLGF (seq. 1) comprises a DVD heavy chain amino acid sequence selected from the group consisting of SEQ ID NO. 343 and SEQ ID NO. 345; and a DVD light chain amino acid sequence selected from the group consisting of SEQ ID NO. 344 and SEQ ID NO. 346. In an embodiment, the binding protein capable of binding VEGF (seq. 1) and PLGF (seq. 1) comprises a DVD heavy chain amino acid sequence of SEQ ID NO. 343 and a DVD light chain amino acid sequence of SEQ ID NO: 344. In another embodiment, the binding protein capable of binding VEGF (seq. 1) and PLGF (seq. 1) has a reverse orientation and comprises a DVD heavy chain amino acid sequence of SEQ ID NO. 345 and a DVD light chain amino acid sequence of SEQ ID NO: 346.

In a second embodiment, the binding protein capable of binding VEGF (seq. 1) and PLGF (seq. 1) comprises a DVD heavy chain amino acid sequence selected from the group consisting of SEQ ID NO. 347 and SEQ ID NO. 349; and a DVD light chain amino acid sequence selected from the group consisting of SEQ ID NO. 348 and SEQ ID NO. 350. In an embodiment, the binding protein capable of binding VEGF (seq. 1) and PLGF (seq. 1) comprises a DVD heavy chain amino acid sequence of SEQ ID NO. 347 and a DVD light chain amino acid sequence of SEQ ID NO: 348. In another embodiment, the binding protein capable of binding VEGF (seq. 1) and PLGF (seq. 1) has a reverse orientation and comprises a DVD heavy chain amino acid sequence of SEQ ID NO. 349 and a DVD light chain amino acid sequence of SEQ ID NO: 350.

In a third embodiment, the binding protein capable of binding VEGF (seq. 1) and PLGF (seq. 1) comprises a DVD heavy chain amino acid sequence selected from the group consisting of SEQ ID NO. 351 and SEQ ID NO. 353; and a DVD light chain amino acid sequence selected from the group consisting of SEQ ID NO. 352 and SEQ ID NO. 354. In an embodiment, the binding protein capable of binding VEGF (seq. 1) and PLGF (seq. 1) comprises a DVD heavy chain amino acid sequence of SEQ ID NO. 351 and a DVD light chain amino acid sequence of SEQ ID NO: 352. In another embodiment, the binding protein capable of binding VEGF (seq. 1) and PLGF (seq. 1) has a reverse orientation and comprises a DVD heavy chain amino acid sequence of SEQ ID NO. 353 and a DVD light chain amino acid sequence of SEQ ID NO: 354.

In a fourth embodiment, the binding protein capable of binding VEGF (seq. 1) and PLGF (seq. 1) comprises a DVD heavy chain amino acid sequence selected from the group consisting of SEQ ID NO. 355 and SEQ ID NO. 357; and a DVD light chain amino acid sequence selected from the group consisting of SEQ ID NO. 356 and SEQ ID NO. 358. In an embodiment, the binding protein capable of binding VEGF (seq. 1) and PLGF (seq. 1) comprises a DVD heavy chain amino acid sequence of SEQ ID NO. 355 and a DVD light chain amino acid sequence of SEQ ID NO: 356. In another embodiment, the binding protein capable of binding VEGF (seq. 1) and PLGF (seq. 1) has a reverse orientation and comprises a DVD heavy chain amino acid sequence of SEQ ID NO. 357 and a DVD light chain amino acid sequence of SEQ ID NO: 358.

In an embodiment, the binding protein capable of binding EGFR (seq. 2) and ErbB3 (seq. 1) comprises a DVD heavy chain amino acid sequence selected from the group consisting of SEQ ID NO. 359 and SEQ ID NO. 361; and a DVD light chain amino acid sequence selected from the group consisting of SEQ ID NO. 360 and SEQ ID NO. 362. In an embodiment, the binding protein capable of binding EGFR (seq. 2) and ErbB3 (seq. 1) comprises a DVD heavy chain amino acid sequence of SEQ ID NO. 359 and a DVD light chain amino acid sequence of SEQ ID NO: 360. In another embodiment, the binding protein capable of binding EGFR (seq. 2) and ErbB3 (seq. 1) has a reverse orientation and comprises a DVD heavy chain amino acid sequence of SEQ ID NO. 361 and a DVD light chain amino acid sequence of SEQ ID NO: 362.

In a second embodiment, the binding protein capable of binding EGFR (seq. 2) and ErbB3 (seq. 1) comprises a DVD heavy chain amino acid sequence selected from the group consisting of SEQ ID NO. 363 and SEQ ID NO. 365; and a DVD light chain amino acid sequence selected from the group consisting of SEQ ID NO. 364 and SEQ ID NO. 366. In an embodiment, the binding protein capable of binding EGFR (seq. 2) and ErbB3 (seq. 1) comprises a DVD heavy chain amino acid sequence of SEQ ID NO. 363 and a DVD light chain amino acid sequence of SEQ ID NO: 364. In another embodiment, the binding protein capable of binding EGFR (seq. 2) and ErbB3 (seq. 1) has a reverse orientation and comprises a DVD heavy chain amino acid sequence of SEQ ID NO. 365 and a DVD light chain amino acid sequence of SEQ ID NO: 366.

In a third embodiment, the binding protein capable of binding EGFR (seq. 2) and ErbB3 (seq. 1) comprises a DVD heavy chain amino acid sequence selected from the group consisting of SEQ ID NO. 367 and SEQ ID NO. 369; and a DVD light chain amino acid sequence selected from the group consisting of SEQ ID NO. 368 and SEQ ID NO. 370. In an embodiment, the binding protein capable of binding EGFR (seq. 2) and ErbB3 (seq. 1) comprises a DVD heavy chain amino acid sequence of SEQ ID NO. 367 and a DVD light chain amino acid sequence of SEQ ID NO: 368. In another embodiment, the binding protein capable of binding EGFR (seq. 2) and ErbB3 (seq. 1) has a reverse orientation and comprises a DVD heavy chain amino acid sequence of SEQ ID NO. 369 and a DVD light chain amino acid sequence of SEQ ID NO: 370.

In a fourth embodiment, the binding protein capable of binding EGFR (seq. 2) and ErbB3 (seq. 1) comprises a DVD heavy chain amino acid sequence selected from the group consisting of SEQ ID NO. 371 and SEQ ID NO. 373; and a DVD light chain amino acid sequence selected from the group consisting of SEQ ID NO. 372 and SEQ ID NO. 374. In an embodiment, the binding protein capable of binding EGFR (seq. 2) and ErbB3 (seq. 1) comprises a DVD heavy chain amino acid sequence of SEQ ID NO. 371 and a DVD light chain amino acid sequence of SEQ ID NO: 372. In another embodiment, the binding protein capable of binding EGFR (seq. 2) and ErbB3 (seq. 1) has a reverse orientation and comprises a DVD heavy chain amino acid sequence of SEQ ID NO. 373 and a DVD light chain amino acid sequence of SEQ ID NO: 374.

In an embodiment, the binding protein capable of binding EGFR (seq. 1) and ErbB3 (seq. 1) comprises a DVD heavy chain amino acid sequence selected from the group consisting of SEQ ID NO. 375 and SEQ ID NO. 377; and a DVD light chain amino acid sequence selected from the group consisting of SEQ ID NO. 376 and SEQ ID NO. 378. In an embodiment, the binding protein capable of binding EGFR (seq. 1) and ErbB3 (seq. 1) comprises a DVD heavy chain amino acid sequence of SEQ ID NO. 375 and a DVD light chain amino acid sequence of SEQ ID NO: 376. In another embodiment, the binding protein capable of binding EGFR (seq. 1) and ErbB3 (seq. 1) has a reverse orientation and comprises a DVD heavy chain amino acid sequence of SEQ ID NO. 377 and a DVD light chain amino acid sequence of SEQ ID NO: 378.

In an embodiment, the binding protein capable of binding HGF (seq. 1) and ErbB3 (seq. 1) comprises a DVD heavy chain amino acid sequence selected from the group consisting of SEQ ID NO. 379 and SEQ ID NO. 381; and a DVD light chain amino acid sequence selected from the group consisting of SEQ ID NO. 380 and SEQ ID NO. 382. In an embodiment, the binding protein capable of binding HGF (seq. 1) and ErbB3 (seq. 1) comprises a DVD heavy chain amino acid sequence of SEQ ID NO. 379 and a DVD light chain amino acid sequence of SEQ ID NO: 380. In another embodiment, the binding protein capable of binding HGF (seq. 1) and ErbB3 (seq. 1) has a reverse orientation and comprises a DVD heavy chain amino acid sequence of SEQ ID NO. 381 and a DVD light chain amino acid sequence of SEQ ID NO: 382.

In an embodiment, the binding protein capable of binding EGFR (seq. 2) and ErbB3 (seq. 2) comprises a DVD heavy chain amino acid sequence selected from the group consisting of SEQ ID NO. 383 and SEQ ID NO. 385; and a DVD light chain amino acid sequence selected from the group consisting of SEQ ID NO. 384 and SEQ ID NO. 386. In an embodiment, the binding protein capable of binding EGFR (seq. 2) and ErbB3 (seq. 2) comprises a DVD heavy chain amino acid sequence of SEQ ID NO. 383 and a DVD light chain amino acid sequence of SEQ ID NO: 384. In another embodiment, the binding protein capable of binding EGFR (seq. 2) and ErbB3 (seq. 2) has a reverse orientation and comprises a DVD heavy chain amino acid sequence of SEQ ID NO. 385 and a DVD light chain amino acid sequence of SEQ ID NO: 386.

In a second embodiment, the binding protein capable of binding EGFR (seq. 2) and ErbB3 (seq. 2) comprises a DVD heavy chain amino acid sequence selected from the group consisting of SEQ ID NO. 387 and SEQ ID NO. 389; and a DVD light chain amino acid sequence selected from the group consisting of SEQ ID NO. 388 and SEQ ID NO. 390. In an embodiment, the binding protein capable of binding EGFR (seq. 2) and ErbB3 (seq. 2) comprises a DVD heavy chain amino acid sequence of SEQ ID NO. 387 and a DVD light chain amino acid sequence of SEQ ID NO: 388. In another embodiment, the binding protein capable of binding EGFR (seq. 2) and ErbB3 (seq. 2) has a reverse orientation and comprises a DVD heavy chain amino acid sequence of SEQ ID NO. 389 and a DVD light chain amino acid sequence of SEQ ID NO: 390.

In a third embodiment, the binding protein capable of binding EGFR (seq. 2) and ErbB3 (seq. 2) comprises a DVD heavy chain amino acid sequence selected from the group consisting of SEQ ID NO. 391 and SEQ ID NO. 393; and a DVD light chain amino acid sequence selected from the group consisting of SEQ ID NO. 392 and SEQ ID NO. 394. In an embodiment, the binding protein capable of binding EGFR (seq. 2) and ErbB3 (seq. 2) comprises a DVD heavy chain amino acid sequence of SEQ ID NO. 391 and a DVD light chain amino acid sequence of SEQ ID NO: 392. In another embodiment, the binding protein capable of binding EGFR (seq. 2) and ErbB3 (seq. 2) has a reverse orientation and comprises a DVD heavy chain amino acid sequence of SEQ ID NO. 393 and a DVD light chain amino acid sequence of SEQ ID NO: 394.

In a fourth embodiment, the binding protein capable of binding EGFR (seq. 2) and ErbB3 (seq. 2) comprises a DVD heavy chain amino acid sequence selected from the group consisting of SEQ ID NO. 395 and SEQ ID NO. 397; and a DVD light chain amino acid sequence selected from the group consisting of SEQ ID NO. 396 and SEQ ID NO. 398. In an embodiment, the binding protein capable of binding EGFR (seq. 2) and ErbB3 (seq. 2) comprises a DVD heavy chain amino acid sequence of SEQ ID NO. 395 and a DVD light chain amino acid sequence of SEQ ID NO: 396. In another embodiment, the binding protein capable of binding EGFR (seq. 2) and ErbB3 (seq. 2) has a reverse orientation and comprises a DVD heavy chain amino acid sequence of SEQ ID NO. 397 and a DVD light chain amino acid sequence of SEQ ID NO: 398.

In an embodiment, the binding protein capable of binding EGFR (seq. 1) and ErbB3 (seq. 2) comprises a DVD heavy chain amino acid sequence selected from the group consisting of SEQ ID NO. 399 and SEQ ID NO. 401; and a DVD light chain amino acid sequence selected from the group consisting of SEQ ID NO. 400 and SEQ ID NO. 402. In an embodiment, the binding protein capable of binding EGFR (seq. 1) and ErbB3 (seq. 2) comprises a DVD heavy chain amino acid sequence of SEQ ID NO. 399 and a DVD light chain amino acid sequence of SEQ ID NO: 400. In another embodiment, the binding protein capable of binding EGFR (seq. 1) and ErbB3 (seq. 2) has a reverse orientation and comprises a DVD heavy chain amino acid sequence of SEQ ID NO. 401 and a DVD light chain amino acid sequence of SEQ ID NO: 402.

In an embodiment, the binding protein capable of binding HGF (seq. 1) and ErbB3 (seq. 2) comprises a DVD heavy chain amino acid sequence selected from the group consisting of SEQ ID NO. 403 and SEQ ID NO. 405; and a DVD light chain amino acid sequence selected from the group consisting of SEQ ID NO. 404 and SEQ ID NO. 406. In an embodiment, the binding protein capable of binding HGF (seq. 1) and ErbB3 (seq. 2) comprises a DVD heavy chain amino acid sequence of SEQ ID NO. 403 and a DVD light chain amino acid sequence of SEQ ID NO: 404. In another embodiment, the binding protein capable of binding HGF (seq. 1) and ErbB3 (seq. 2) has a reverse orientation and comprises a DVD heavy chain amino acid sequence of SEQ ID NO. 405 and a DVD light chain amino acid sequence of SEQ ID NO: 406.

In an embodiment, the binding protein capable of binding VEGF (seq. 1) and DLL-4 (seq. 2) comprises a DVD heavy chain amino acid sequence selected from the group consisting of SEQ ID NO. 407 and SEQ ID NO. 409; and a DVD light chain amino acid sequence selected from the group consisting of SEQ ID NO. 408 and SEQ ID NO. 410. In an embodiment, the binding protein capable of binding VEGF (seq. 1) and DLL-4 (seq. 2) comprises a DVD heavy chain amino acid sequence of SEQ ID NO. 407 and a DVD light chain amino acid sequence of SEQ ID NO: 408. In another embodiment, the binding protein capable of binding VEGF (seq. 1) and DLL-4 (seq. 2) has a reverse orientation and comprises a DVD heavy chain amino acid sequence of SEQ ID NO. 409 and a DVD light chain amino acid sequence of SEQ ID NO: 410.

In a second embodiment, the binding protein capable of binding VEGF (seq. 1) and DLL-4 (seq. 2) comprises a DVD heavy chain amino acid sequence selected from the group consisting of SEQ ID NO. 411 and SEQ ID NO. 413; and a DVD light chain amino acid sequence selected from the group consisting of SEQ ID NO. 412 and SEQ ID NO. 414. In an embodiment, the binding protein capable of binding VEGF (seq. 1) and DLL-4 (seq. 2) comprises a DVD heavy chain amino acid sequence of SEQ ID NO. 411 and a DVD light chain amino acid sequence of SEQ ID NO: 412. In another embodiment, the binding protein capable of binding VEGF (seq. 1) and DLL-4 (seq. 2) has a reverse orientation and comprises a DVD heavy chain amino acid sequence of SEQ ID NO. 413 and a DVD light chain amino acid sequence of SEQ ID NO: 414.

In a third embodiment, the binding protein capable of binding VEGF (seq. 1) and DLL-4 (seq. 2) comprises a DVD heavy chain amino acid sequence selected from the group consisting of SEQ ID NO. 415 and SEQ ID NO. 417; and a DVD light chain amino acid sequence selected from the group consisting of SEQ ID NO. 416 and SEQ ID NO. 418. In an embodiment, the binding protein capable of binding VEGF (seq. 1) and DLL-4 (seq. 2) comprises a DVD heavy chain amino acid sequence of SEQ ID NO. 415 and a DVD light chain amino acid sequence of SEQ ID NO: 416. In another embodiment, the binding protein capable of binding VEGF (seq. 1) and DLL-4 (seq. 2) has a reverse orientation and comprises a DVD heavy chain amino acid sequence of SEQ ID NO. 417 and a DVD light chain amino acid sequence of SEQ ID NO: 418.

In a fourth embodiment, the binding protein capable of binding VEGF (seq. 1) and DLL-4 (seq. 2) comprises a DVD heavy chain amino acid sequence selected from the group consisting of SEQ ID NO. 419 and SEQ ID NO. 421; and a DVD light chain amino acid sequence selected from the group consisting of SEQ ID NO. 420 and SEQ ID NO. 422. In an embodiment, the binding protein capable of binding VEGF (seq. 1) and DLL-4 (seq. 2) comprises a DVD heavy chain amino acid sequence of SEQ ID NO. 419 and a DVD light chain amino acid sequence of SEQ ID NO: 420. In another embodiment, the binding protein capable of binding VEGF (seq. 1) and DLL-4 (seq. 2) has a reverse orientation and comprises a DVD heavy chain amino acid sequence of SEQ ID NO. 421 and a DVD light chain amino acid sequence of SEQ ID NO: 422.

In an embodiment, the binding protein capable of binding VEGF (seq. 2) and DLL-4 (seq. 2) comprises a DVD heavy chain amino acid sequence selected from the group consisting of SEQ ID NO. 423 and SEQ ID NO. 425; and a DVD light chain amino acid sequence selected from the group consisting of SEQ ID NO. 424 and SEQ ID NO. 426. In an embodiment, the binding protein capable of binding VEGF (seq. 2) and DLL-4 (seq. 2) comprises a DVD heavy chain amino acid sequence of SEQ ID NO. 423 and a DVD light chain amino acid sequence of SEQ ID NO: 424. In another embodiment, the binding protein capable of binding VEGF (seq. 2) and DLL-4 (seq. 2) has a reverse orientation and comprises a DVD heavy chain amino acid sequence of SEQ ID NO. 425 and a DVD light chain amino acid sequence of SEQ ID NO: 426.

In a second embodiment, the binding protein capable of binding VEGF (seq. 2) and DLL-4 (seq. 2) comprises a DVD heavy chain amino acid sequence selected from the group consisting of SEQ ID NO. 427 and SEQ ID NO. 429; and a DVD light chain amino acid sequence selected from the group consisting of SEQ ID NO. 428 and SEQ ID NO. 430. In an embodiment, the binding protein capable of binding VEGF (seq. 2) and DLL-4 (seq. 2) comprises a DVD heavy chain amino acid sequence of SEQ ID NO. 427 and a DVD light chain amino acid sequence of SEQ ID NO: 428. In another embodiment, the binding protein capable of binding VEGF (seq. 2) and DLL-4 (seq. 2) has a reverse orientation and comprises a DVD heavy chain amino acid sequence of SEQ ID NO. 429 and a DVD light chain amino acid sequence of SEQ ID NO: 430.

In a third embodiment, the binding protein capable of binding VEGF (seq. 2) and DLL-4 (seq. 2) comprises a DVD heavy chain amino acid sequence selected from the group consisting of SEQ ID NO. 431 and SEQ ID NO. 433; and a DVD light chain amino acid sequence selected from the group consisting of SEQ ID NO. 432 and SEQ ID NO. 434. In an embodiment, the binding protein capable of binding VEGF (seq. 2) and DLL-4 (seq. 2) comprises a DVD heavy chain amino acid sequence of SEQ ID NO. 431 and a DVD light chain amino acid sequence of SEQ ID NO: 432. In another embodiment, the binding protein capable of binding VEGF (seq. 2) and DLL-4 (seq. 2) has a reverse orientation and comprises a DVD heavy chain amino acid sequence of SEQ ID NO. 433 and a DVD light chain amino acid sequence of SEQ ID NO: 434.

In a fourth embodiment, the binding protein capable of binding VEGF (seq. 2) and DLL-4 (seq. 2) comprises a DVD heavy chain amino acid sequence selected from the group consisting of SEQ ID NO. 435 and SEQ ID NO. 437; and a DVD light chain amino acid sequence selected from the group consisting of SEQ ID NO. 436 and SEQ ID NO. 438. In an embodiment, the binding protein capable of binding VEGF (seq. 2) and DLL-4 (seq. 2) comprises a DVD heavy chain amino acid sequence of SEQ ID NO. 435 and a DVD light chain amino acid sequence of SEQ ID NO: 436. In another embodiment, the binding protein capable of binding VEGF (seq. 2) and DLL-4 (seq. 2) has a reverse orientation and comprises a DVD heavy chain amino acid sequence of SEQ ID NO. 437 and a DVD light chain amino acid sequence of SEQ ID NO: 438.

In an embodiment, the binding protein capable of binding VEGF (seq. 3) and DLL-4 (seq. 2) comprises a DVD heavy chain amino acid sequence selected from the group consisting of SEQ ID NO. 439 and SEQ ID NO. 441; and a DVD light chain amino acid sequence selected from the group consisting of SEQ ID NO. 440 and SEQ ID NO. 442. In an embodiment, the binding protein capable of binding VEGF (seq. 3) and DLL-4 (seq. 2) comprises a DVD heavy chain amino acid sequence of SEQ ID NO. 439 and a DVD light chain amino acid sequence of SEQ ID NO: 440. In another embodiment, the binding protein capable of binding VEGF (seq. 3) and DLL-4 (seq. 2) has a reverse orientation and comprises a DVD heavy chain amino acid sequence of SEQ ID NO. 441 and a DVD light chain amino acid sequence of SEQ ID NO: 442.

In a second embodiment, the binding protein capable of binding VEGF (seq. 3) and DLL-4 (seq. 2) comprises a DVD heavy chain amino acid sequence selected from the group consisting of SEQ ID NO. 443 and SEQ ID NO. 445; and a DVD light chain amino acid sequence selected from the group consisting of SEQ ID NO. 444 and SEQ ID NO. 446. In an embodiment, the binding protein capable of binding VEGF (seq. 3) and DLL-4 (seq. 2) comprises a DVD heavy chain amino acid sequence of SEQ ID NO. 443 and a DVD light chain amino acid sequence of SEQ ID NO: 444. In another embodiment, the binding protein capable of binding VEGF (seq. 3) and DLL-4 (seq. 2) has a reverse orientation and comprises a DVD heavy chain amino acid sequence of SEQ ID NO. 445 and a DVD light chain amino acid sequence of SEQ ID NO: 446.

In a third embodiment, the binding protein capable of binding VEGF (seq. 3) and DLL-4 (seq. 2) comprises a DVD heavy chain amino acid sequence selected from the group consisting of SEQ ID NO. 447 and SEQ ID NO. 449; and a DVD light chain amino acid sequence selected from the group consisting of SEQ ID NO. 448 and SEQ ID NO. 450. In an embodiment, the binding protein capable of binding VEGF (seq. 3) and DLL-4 (seq. 2) comprises a DVD heavy chain amino acid sequence of SEQ ID NO. 447 and a DVD light chain amino acid sequence of SEQ ID NO: 448. In another embodiment, the binding protein capable of binding VEGF (seq. 3) and DLL-4 (seq. 2) has a reverse orientation and comprises a DVD heavy chain amino acid sequence of SEQ ID NO. 449 and a DVD light chain amino acid sequence of SEQ ID NO: 450.

In a fourth embodiment, the binding protein capable of binding VEGF (seq. 3) and DLL-4 (seq. 2) comprises a DVD heavy chain amino acid sequence selected from the group consisting of SEQ ID NO. 451 and SEQ ID NO. 453; and a DVD light chain amino acid sequence selected from the group consisting of SEQ ID NO. 452 and SEQ ID NO. 454. In an embodiment, the binding protein capable of binding VEGF (seq. 3) and DLL-4 (seq. 2) comprises a DVD heavy chain amino acid sequence of SEQ ID NO. 451 and a DVD light chain amino acid sequence of SEQ ID NO: 452. In another embodiment, the binding protein capable of binding VEGF (seq. 3) and DLL-4 (seq. 2) has a reverse orientation and comprises a DVD heavy chain amino acid sequence of SEQ ID NO. 453 and a DVD light chain amino acid sequence of SEQ ID NO: 454.

In an embodiment, the binding protein capable of binding VEGF (seq. 2) and DLL-4 (seq. 1) comprises a DVD heavy chain amino acid sequence selected from the group consisting of SEQ ID NO. 455 and SEQ ID NO. 457; and a DVD light chain amino acid sequence selected from the group consisting of SEQ ID NO. 456 and SEQ ID NO. 458. In an embodiment, the binding protein capable of binding VEGF (seq. 2) and DLL-4 (seq. 1) comprises a DVD heavy chain amino acid sequence of SEQ ID NO. 455 and a DVD light chain amino acid sequence of SEQ ID NO: 456. In another embodiment, the binding protein capable of binding VEGF (seq. 2) and DLL-4 (seq. 1) has a reverse orientation and comprises a DVD heavy chain amino acid sequence of SEQ ID NO. 457 and a DVD light chain amino acid sequence of SEQ ID NO: 458.

In a second embodiment, the binding protein capable of binding VEGF (seq. 2) and DLL-4 (seq. 1) comprises a DVD heavy chain amino acid sequence selected from the group consisting of SEQ ID NO. 459 and SEQ ID NO. 461; and a DVD light chain amino acid sequence selected from the group consisting of SEQ ID NO. 460 and SEQ ID NO. 462. In an embodiment, the binding protein capable of binding VEGF (seq. 2) and DLL-4 (seq. 1) comprises a DVD heavy chain amino acid sequence of SEQ ID NO. 459 and a DVD light chain amino acid sequence of SEQ ID NO: 460. In another embodiment, the binding protein capable of binding VEGF (seq. 2) and DLL-4 (seq. 1) has a reverse orientation and comprises a DVD heavy chain amino acid sequence of SEQ ID NO. 461 and a DVD light chain amino acid sequence of SEQ ID NO: 462.

In a third embodiment, the binding protein capable of binding VEGF (seq. 2) and DLL-4 (seq. 1) comprises a DVD heavy chain amino acid sequence selected from the group consisting of SEQ ID NO. 463 and SEQ ID NO. 465; and a DVD light chain amino acid sequence selected from the group consisting of SEQ ID NO. 464 and SEQ ID NO. 466. In an embodiment, the binding protein capable of binding VEGF (seq. 2) and DLL-4 (seq. 1) comprises a DVD heavy chain amino acid sequence of SEQ ID NO. 463 and a DVD light chain amino acid sequence of SEQ ID NO: 464. In another embodiment, the binding protein capable of binding VEGF (seq. 2) and DLL-4 (seq. 1) has a reverse orientation and comprises a DVD heavy chain amino acid sequence of SEQ ID NO. 465 and a DVD light chain amino acid sequence of SEQ ID NO: 466.

In a fourth embodiment, the binding protein capable of binding VEGF (seq. 2) and DLL-4 (seq. 1) comprises a DVD heavy chain amino acid sequence selected from the group consisting of SEQ ID NO. 467 and SEQ ID NO. 469; and a DVD light chain amino acid sequence selected from the group consisting of SEQ ID NO. 468 and SEQ ID NO. 470. In an embodiment, the binding protein capable of binding VEGF (seq. 2) and DLL-4 (seq. 1) comprises a DVD heavy chain amino acid sequence of SEQ ID NO. 467 and a DVD light chain amino acid sequence of SEQ ID NO: 468. In another embodiment, the binding protein capable of binding VEGF (seq. 2) and DLL-4 (seq. 1) has a reverse orientation and comprises a DVD heavy chain amino acid sequence of SEQ ID NO. 469 and a DVD light chain amino acid sequence of SEQ ID NO: 470.

In an embodiment, the binding protein capable of binding VEGF (seq. 3) and DLL-4 (seq. 1) comprises a DVD heavy chain amino acid sequence selected from the group consisting of SEQ ID NO. 471 and SEQ ID NO. 473; and a DVD light chain amino acid sequence selected from the group consisting of SEQ ID NO. 472 and SEQ ID NO. 474. In an embodiment, the binding protein capable of binding VEGF (seq. 3) and DLL-4 (seq. 1) comprises a DVD heavy chain amino acid sequence of SEQ ID NO. 471 and a DVD light chain amino acid sequence of SEQ ID NO: 472. In another embodiment, the binding protein capable of binding VEGF (seq. 3) and DLL-4 (seq. 1) has a reverse orientation and comprises a DVD heavy chain amino acid sequence of SEQ ID NO. 473 and a DVD light chain amino acid sequence of SEQ ID NO: 474.

In a second embodiment, the binding protein capable of binding VEGF (seq. 3) and DLL-4 (seq. 1) comprises a DVD heavy chain amino acid sequence selected from the group consisting of SEQ ID NO. 475 and SEQ ID NO. 477; and a DVD light chain amino acid sequence selected from the group consisting of SEQ ID NO. 476 and SEQ ID NO. 478. In an embodiment, the binding protein capable of binding VEGF (seq. 3) and DLL-4 (seq. 1) comprises a DVD heavy chain amino acid sequence of SEQ ID NO. 475 and a DVD light chain amino acid sequence of SEQ ID NO: 476. In another embodiment, the binding protein capable of binding VEGF (seq. 3) and DLL-4 (seq. 1) has a reverse orientation and comprises a DVD heavy chain amino acid sequence of SEQ ID NO. 477 and a DVD light chain amino acid sequence of SEQ ID NO: 478.

In a third embodiment, the binding protein capable of binding VEGF (seq. 3) and DLL-4 (seq. 1) comprises a DVD heavy chain amino acid sequence selected from the group consisting of SEQ ID NO. 479 and SEQ ID NO. 481; and a DVD light chain amino acid sequence selected from the group consisting of SEQ ID NO. 480 and SEQ ID NO. 482. In an embodiment, the binding protein capable of binding VEGF (seq. 3) and DLL-4 (seq. 1) comprises a DVD heavy chain amino acid sequence of SEQ ID NO. 479 and a DVD light chain amino acid sequence of SEQ ID NO: 480. In another embodiment, the binding protein capable of binding VEGF (seq. 3) and DLL-4 (seq. 1) has a reverse orientation and comprises a DVD heavy chain amino acid sequence of SEQ ID NO. 481 and a DVD light chain amino acid sequence of SEQ ID NO: 482.

In a fourth embodiment, the binding protein capable of binding VEGF (seq. 3) and DLL-4 (seq. 1) comprises a DVD heavy chain amino acid sequence selected from the group consisting of SEQ ID NO. 483 and SEQ ID NO. 485; and a DVD light chain amino acid sequence selected from the group consisting of SEQ ID NO. 484 and SEQ ID NO. 486. In an embodiment, the binding protein capable of binding VEGF (seq. 3) and DLL-4 (seq. 1) comprises a DVD heavy chain amino acid sequence of SEQ ID NO. 483 and a DVD light chain amino acid sequence of SEQ ID NO: 484. In another embodiment, the binding protein capable of binding VEGF (seq. 3) and DLL-4 (seq. 1) has a reverse orientation and comprises a DVD heavy chain amino acid sequence of SEQ ID NO. 485 and a DVD light chain amino acid sequence of SEQ ID NO: 486.

In an embodiment, the binding protein capable of binding VEGF (seq. 1) and DLL-4 (seq. 1) comprises a DVD heavy chain amino acid sequence selected from the group consisting of SEQ ID NO. 487 and SEQ ID NO. 489; and a DVD light chain amino acid sequence selected from the group consisting of SEQ ID NO. 488 and SEQ ID NO. 490. In an embodiment, the binding protein capable of binding VEGF (seq. 1) and DLL-4 (seq. 1) comprises a DVD heavy chain amino acid sequence of SEQ ID NO. 487 and a DVD light chain amino acid sequence of SEQ ID NO: 488. In another embodiment, the binding protein capable of binding VEGF (seq. 1) and DLL-4 (seq. 1) has a reverse orientation and comprises a DVD heavy chain amino acid sequence of SEQ ID NO. 489 and a DVD light chain amino acid sequence of SEQ ID NO: 490.

In a second embodiment, the binding protein capable of binding VEGF (seq. 1) and DLL-4 (seq. 1) comprises a DVD heavy chain amino acid sequence selected from the group consisting of SEQ ID NO. 491 and SEQ ID NO. 493; and a DVD light chain amino acid sequence selected from the group consisting of SEQ ID NO. 492 and SEQ ID NO. 494. In an embodiment, the binding protein capable of binding VEGF (seq. 1) and DLL-4 (seq. 1) comprises a DVD heavy chain amino acid sequence of SEQ ID NO. 491 and a DVD light chain amino acid sequence of SEQ ID NO: 492. In another embodiment, the binding protein capable of binding VEGF (seq. 1) and DLL-4 (seq. 1) has a reverse orientation and comprises a DVD heavy chain amino acid sequence of SEQ ID NO. 493 and a DVD light chain amino acid sequence of SEQ ID NO: 494.

In a third embodiment, the binding protein capable of binding VEGF (seq. 1) and DLL-4 (seq. 1) comprises a DVD heavy chain amino acid sequence selected from the group consisting of SEQ ID NO. 495 and SEQ ID NO. 497; and a DVD light chain amino acid sequence selected from the group consisting of SEQ ID NO. 496 and SEQ ID NO. 498. In an embodiment, the binding protein capable of binding VEGF (seq. 1) and DLL-4 (seq. 1) comprises a DVD heavy chain amino acid sequence of SEQ ID NO. 495 and a DVD light chain amino acid sequence of SEQ ID NO: 496. In another embodiment, the binding protein capable of binding VEGF (seq. 1) and DLL-4 (seq. 1) has a reverse orientation and comprises a DVD heavy chain amino acid sequence of SEQ ID NO. 497 and a DVD light chain amino acid sequence of SEQ ID NO: 498.

In an embodiment, the binding protein capable of binding VEGF (seq. 1) and DLL-4 (seq. 3) comprises a DVD heavy chain amino acid sequence selected from the group consisting of SEQ ID NO. 499 and SEQ ID NO. 501; and a DVD light chain amino acid sequence selected from the group consisting of SEQ ID NO. 500 and SEQ ID NO. 502. In an embodiment, the binding protein capable of binding VEGF (seq. 1) and DLL-4 (seq. 3) comprises a DVD heavy chain amino acid sequence of SEQ ID NO. 499 and a DVD light chain amino acid sequence of SEQ ID NO: 500. In another embodiment, the binding protein capable of binding VEGF (seq. 1) and DLL-4 (seq. 3) has a reverse orientation and comprises a DVD heavy chain amino acid sequence of SEQ ID NO. 501 and a DVD light chain amino acid sequence of SEQ ID NO: 502.

In a second embodiment, the binding protein capable of binding VEGF (seq. 1) and DLL-4 (seq. 3) comprises a DVD heavy chain amino acid sequence selected from the group consisting of SEQ ID NO. 503 and SEQ ID NO. 505; and a DVD light chain amino acid sequence selected from the group consisting of SEQ ID NO. 504 and SEQ ID NO. 506. In an embodiment, the binding protein capable of binding VEGF (seq. 1) and DLL-4 (seq. 3) comprises a DVD heavy chain amino acid sequence of SEQ ID NO. 503 and a DVD light chain amino acid sequence of SEQ ID NO: 504. In another embodiment, the binding protein capable of binding VEGF (seq. 1) and DLL-4 (seq. 3) has a reverse orientation and comprises a DVD heavy chain amino acid sequence of SEQ ID NO. 505 and a DVD light chain amino acid sequence of SEQ ID NO: 506.

In a third embodiment, the binding protein capable of binding VEGF (seq. 1) and DLL-4 (seq. 3) comprises a DVD heavy chain amino acid sequence selected from the group consisting of SEQ ID NO. 507 and SEQ ID NO. 509; and a DVD light chain amino acid sequence selected from the group consisting of SEQ ID NO. 508 and SEQ ID NO. 510. In an embodiment, the binding protein capable of binding VEGF (seq. 1) and DLL-4 (seq. 3) comprises a DVD heavy chain amino acid sequence of SEQ ID NO. 507 and a DVD light chain amino acid sequence of SEQ ID NO: 508. In another embodiment, the binding protein capable of binding VEGF (seq. 1) and DLL-4 (seq. 3) has a reverse orientation and comprises a DVD heavy chain amino acid sequence of SEQ ID NO. 509 and a DVD light chain amino acid sequence of SEQ ID NO: 510.

In a fourth embodiment, the binding protein capable of binding VEGF (seq. 1) and DLL-4 (seq. 3) comprises a DVD heavy chain amino acid sequence selected from the group consisting of SEQ ID NO. 511 and SEQ ID NO. 513; and a DVD light chain amino acid sequence selected from the group consisting of SEQ ID NO. 512 and SEQ ID NO. 514. In an embodiment, the binding protein capable of binding VEGF (seq. 1) and DLL-4 (seq. 3) comprises a DVD heavy chain amino acid sequence of SEQ ID NO. 511 and a DVD light chain amino acid sequence of SEQ ID NO: 512. In another embodiment, the binding protein capable of binding VEGF (seq. 1) and DLL-4 (seq. 3) has a reverse orientation and comprises a DVD heavy chain amino acid sequence of SEQ ID NO. 513 and a DVD light chain amino acid sequence of SEQ ID NO: 514.

In an embodiment, the binding protein capable of binding VEGF (seq. 2) and DLL-4 (seq. 3) comprises a DVD heavy chain amino acid sequence selected from the group consisting of SEQ ID NO. 515 and SEQ ID NO. 517; and a DVD light chain amino acid sequence selected from the group consisting of SEQ ID NO. 516 and SEQ ID NO. 518. In an embodiment, the binding protein capable of binding VEGF (seq. 2) and DLL-4 (seq. 3) comprises a DVD heavy chain amino acid sequence of SEQ ID NO. 515 and a DVD light chain amino acid sequence of SEQ ID NO: 516. In another embodiment, the binding protein capable of binding VEGF (seq. 2) and DLL-4 (seq. 3) has a reverse orientation and comprises a DVD heavy chain amino acid sequence of SEQ ID NO. 517 and a DVD light chain amino acid sequence of SEQ ID NO: 518.

In a second embodiment, the binding protein capable of binding VEGF (seq. 2) and DLL-4 (seq. 3) comprises a DVD heavy chain amino acid sequence selected from the group consisting of SEQ ID NO. 519 and SEQ ID NO. 521; and a DVD light chain amino acid sequence selected from the group consisting of SEQ ID NO. 520 and SEQ ID NO. 522. In an embodiment, the binding protein capable of binding VEGF (seq. 2) and DLL-4 (seq. 3) comprises a DVD heavy chain amino acid sequence of SEQ ID NO. 519 and a DVD light chain amino acid sequence of SEQ ID NO: 520. In another embodiment, the binding protein capable of binding VEGF (seq. 2) and DLL-4 (seq. 3) has a reverse orientation and comprises a DVD heavy chain amino acid sequence of SEQ ID NO. 521 and a DVD light chain amino acid sequence of SEQ ID NO: 522.

In a third embodiment, the binding protein capable of binding VEGF (seq. 2) and DLL-4 (seq. 3) comprises a DVD heavy chain amino acid sequence selected from the group consisting of SEQ ID NO. 523 and SEQ ID NO. 525; and a DVD light chain amino acid sequence selected from the group consisting of SEQ ID NO. 524 and SEQ ID NO. 526. In an embodiment, the binding protein capable of binding VEGF (seq. 2) and DLL-4 (seq. 3) comprises a DVD heavy chain amino acid sequence of SEQ ID NO. 523 and a DVD light chain amino acid sequence of SEQ ID NO: 524. In another embodiment, the binding protein capable of binding VEGF (seq. 2) and DLL-4 (seq. 3) has a reverse orientation and comprises a DVD heavy chain amino acid sequence of SEQ ID NO. 525 and a DVD light chain amino acid sequence of SEQ ID NO: 526.

In a fourth embodiment, the binding protein capable of binding VEGF (seq. 2) and DLL-4 (seq. 3) comprises a DVD heavy chain amino acid sequence selected from the group consisting of SEQ ID NO. 527 and SEQ ID NO. 529; and a DVD light chain amino acid sequence selected from the group consisting of SEQ ID NO. 528 and SEQ ID NO. 530. In an embodiment, the binding protein capable of binding VEGF (seq. 2) and DLL-4 (seq. 3) comprises a DVD heavy chain amino acid sequence of SEQ ID NO. 527 and a DVD light chain amino acid sequence of SEQ ID NO: 528. In another embodiment, the binding protein capable of binding VEGF (seq. 2) and DLL-4 (seq. 3) has a reverse orientation and comprises a DVD heavy chain amino acid sequence of SEQ ID NO. 529 and a DVD light chain amino acid sequence of SEQ ID NO: 530.

In an embodiment, the binding protein capable of binding VEGF (seq. 3) and DLL-4 (seq. 3) comprises a DVD heavy chain amino acid sequence selected from the group consisting of SEQ ID NO. 531 and SEQ ID NO. 533; and a DVD light chain amino acid sequence selected from the group consisting of SEQ ID NO. 532 and SEQ ID NO. 534. In an embodiment, the binding protein capable of binding VEGF (seq. 3) and DLL-4 (seq. 3) comprises a DVD heavy chain amino acid sequence of SEQ ID NO. 531 and a DVD light chain amino acid sequence of SEQ ID NO: 532. In another embodiment, the binding protein capable of binding VEGF (seq. 3) and DLL-4 (seq. 3) has a reverse orientation and comprises a DVD heavy chain amino acid sequence of SEQ ID NO. 533 and a DVD light chain amino acid sequence of SEQ ID NO: 534.

In a second embodiment, the binding protein capable of binding VEGF (seq. 3) and DLL-4 (seq. 3) comprises a DVD heavy chain amino acid sequence selected from the group consisting of SEQ ID NO. 535 and SEQ ID NO. 537; and a DVD light chain amino acid sequence selected from the group consisting of SEQ ID NO. 536 and SEQ ID NO. 538. In an embodiment, the binding protein capable of binding VEGF (seq. 3) and DLL-4 (seq. 3) comprises a DVD heavy chain amino acid sequence of SEQ ID NO. 535 and a DVD light chain amino acid sequence of SEQ ID NO: 536. In another embodiment, the binding protein capable of binding VEGF (seq. 3) and DLL-4 (seq. 3) has a reverse orientation and comprises a DVD heavy chain amino acid sequence of SEQ ID NO. 537 and a DVD light chain amino acid sequence of SEQ ID NO: 538.

In a third embodiment, the binding protein capable of binding VEGF (seq. 3) and DLL-4 (seq. 3) comprises a DVD heavy chain amino acid sequence selected from the group consisting of SEQ ID NO. 539 and SEQ ID NO. 541; and a DVD light chain amino acid sequence selected from the group consisting of SEQ ID NO. 540 and SEQ ID NO. 542. In an embodiment, the binding protein capable of binding VEGF (seq. 3) and DLL-4 (seq. 3) comprises a DVD heavy chain amino acid sequence of SEQ ID NO. 539 and a DVD light chain amino acid sequence of SEQ ID NO: 540. In another embodiment, the binding protein capable of binding VEGF (seq. 3) and DLL-4 (seq. 3) has a reverse orientation and comprises a DVD heavy chain amino acid sequence of SEQ ID NO. 541 and a DVD light chain amino acid sequence of SEQ ID NO: 542.

In a fourth embodiment, the binding protein capable of binding VEGF (seq. 3) and DLL-4 (seq. 3) comprises a DVD heavy chain amino acid sequence selected from the group consisting of SEQ ID NO. 543 and SEQ ID NO. 545; and a DVD light chain amino acid sequence selected from the group consisting of SEQ ID NO. 544 and SEQ ID NO. 546. In an embodiment, the binding protein capable of binding VEGF (seq. 3) and DLL-4 (seq. 3) comprises a DVD heavy chain amino acid sequence of SEQ ID NO. 543 and a DVD light chain amino acid sequence of SEQ ID NO: 544. In another embodiment, the binding protein capable of binding VEGF (seq. 3) and DLL-4 (seq. 3) has a reverse orientation and comprises a DVD heavy chain amino acid sequence of SEQ ID NO. 545 and a DVD light chain amino acid sequence of SEQ ID NO: 546.

In an embodiment, the binding protein capable of binding VEGF (seq. 1) and DLL-4 (seq. 4) comprises a DVD heavy chain amino acid sequence selected from the group consisting of SEQ ID NO. 547 and SEQ ID NO. 549; and a DVD light chain amino acid sequence selected from the group consisting of SEQ ID NO. 548 and SEQ ID NO. 550. In an embodiment, the binding protein capable of binding VEGF (seq. 1) and DLL-4 (seq. 4) comprises a DVD heavy chain amino acid sequence of SEQ ID NO. 547 and a DVD light chain amino acid sequence of SEQ ID NO: 548. In another embodiment, the binding protein capable of binding VEGF (seq. 1) and DLL-4 (seq. 4) has a reverse orientation and comprises a DVD heavy chain amino acid sequence of SEQ ID NO. 549 and a DVD light chain amino acid sequence of SEQ ID NO: 550.

In a second embodiment, the binding protein capable of binding VEGF (seq. 1) and DLL-4 (seq. 4) comprises a DVD heavy chain amino acid sequence selected from the group consisting of SEQ ID NO. 551 and SEQ ID NO. 553; and a DVD light chain amino acid sequence selected from the group consisting of SEQ ID NO. 552 and SEQ ID NO. 554. In an embodiment, the binding protein capable of binding VEGF (seq. 1) and DLL-4 (seq. 4) comprises a DVD heavy chain amino acid sequence of SEQ ID NO. 551 and a DVD light chain amino acid sequence of SEQ ID NO: 552. In another embodiment, the binding protein capable of binding VEGF (seq. 1) and DLL-4 (seq. 4) has a reverse orientation and comprises a DVD heavy chain amino acid sequence of SEQ ID NO. 553 and a DVD light chain amino acid sequence of SEQ ID NO: 554.

In a third embodiment, the binding protein capable of binding VEGF (seq. 1) and DLL-4 (seq. 4) comprises a DVD heavy chain amino acid sequence selected from the group consisting of SEQ ID NO. 555 and SEQ ID NO. 557; and a DVD light chain amino acid sequence selected from the group consisting of SEQ ID NO. 556 and SEQ ID NO. 558. In an embodiment, the binding protein capable of binding VEGF (seq. 1) and DLL-4 (seq. 4) comprises a DVD heavy chain amino acid sequence of SEQ ID NO. 555 and a DVD light chain amino acid sequence of SEQ ID NO: 556. In another embodiment, the binding protein capable of binding VEGF (seq. 1) and DLL-4 (seq. 4) has a reverse orientation and comprises a DVD heavy chain amino acid sequence of SEQ ID NO. 557 and a DVD light chain amino acid sequence of SEQ ID NO: 558.

In a fourth embodiment, the binding protein capable of binding VEGF (seq. 1) and DLL-4 (seq. 4) comprises a DVD heavy chain amino acid sequence selected from the group consisting of SEQ ID NO. 559 and SEQ ID NO. 561; and a DVD light chain amino acid sequence selected from the group consisting of SEQ ID NO. 560 and SEQ ID NO. 562. In an embodiment, the binding protein capable of binding VEGF (seq. 1) and DLL-4 (seq. 4) comprises a DVD heavy chain amino acid sequence of SEQ ID NO. 559 and a DVD light chain amino acid sequence of SEQ ID NO: 560. In another embodiment, the binding protein capable of binding VEGF (seq. 1) and DLL-4 (seq. 4) has a reverse orientation and comprises a DVD heavy chain amino acid sequence of SEQ ID NO. 561 and a DVD light chain amino acid sequence of SEQ ID NO: 562.

In an embodiment, the binding protein capable of binding VEGF (seq. 2) and DLL-4 (seq. 4) comprises a DVD heavy chain amino acid sequence selected from the group consisting of SEQ ID NO. 563 and SEQ ID NO. 565; and a DVD light chain amino acid sequence selected from the group consisting of SEQ ID NO. 564 and SEQ ID NO. 566. In an embodiment, the binding protein capable of binding VEGF (seq. 2) and DLL-4 (seq. 4) comprises a DVD heavy chain amino acid sequence of SEQ ID NO. 563 and a DVD light chain amino acid sequence of SEQ ID NO: 564. In another embodiment, the binding protein capable of binding VEGF (seq. 2) and DLL-4 (seq. 4) has a reverse orientation and comprises a DVD heavy chain amino acid sequence of SEQ ID NO. 565 and a DVD light chain amino acid sequence of SEQ ID NO: 566.

In a second embodiment, the binding protein capable of binding VEGF (seq. 2) and DLL-4 (seq. 4) comprises a DVD heavy chain amino acid sequence selected from the group consisting of SEQ ID NO. 567 and SEQ ID NO. 569; and a DVD light chain amino acid sequence selected from the group consisting of SEQ ID NO. 568 and SEQ ID NO. 570. In an embodiment, the binding protein capable of binding VEGF (seq. 2) and DLL-4 (seq. 4) comprises a DVD heavy chain amino acid sequence of SEQ ID NO. 567 and a DVD light chain amino acid sequence of SEQ ID NO: 568. In another embodiment, the binding protein capable of binding VEGF (seq. 2) and DLL-4 (seq. 4) has a reverse orientation and comprises a DVD heavy chain amino acid sequence of SEQ ID NO. 569 and a DVD light chain amino acid sequence of SEQ ID NO: 570.

In a third embodiment, the binding protein capable of binding VEGF (seq. 2) and DLL-4 (seq. 4) comprises a DVD heavy chain amino acid sequence selected from the group consisting of SEQ ID NO. 571 and SEQ ID NO. 573; and a DVD light chain amino acid sequence selected from the group consisting of SEQ ID NO. 572 and SEQ ID NO. 574. In an embodiment, the binding protein capable of binding VEGF (seq. 2) and DLL-4 (seq. 4) comprises a DVD heavy chain amino acid sequence of SEQ ID NO. 571 and a DVD light chain amino acid sequence of SEQ ID NO: 572. In another embodiment, the binding protein capable of binding VEGF (seq. 2) and DLL-4 (seq. 4) has a reverse orientation and comprises a DVD heavy chain amino acid sequence of SEQ ID NO. 573 and a DVD light chain amino acid sequence of SEQ ID NO: 574.

In a fourth embodiment, the binding protein capable of binding VEGF (seq. 2) and DLL-4 (seq. 4) comprises a DVD heavy chain amino acid sequence selected from the group consisting of SEQ ID NO. 575 and SEQ ID NO. 577; and a DVD light chain amino acid sequence selected from the group consisting of SEQ ID NO. 576 and SEQ ID NO. 578. In an embodiment, the binding protein capable of binding VEGF (seq. 2) and DLL-4 (seq. 4) comprises a DVD heavy chain amino acid sequence of SEQ ID NO. 575 and a DVD light chain amino acid sequence of SEQ ID NO: 576. In another embodiment, the binding protein capable of binding VEGF (seq. 2) and DLL-4 (seq. 4) has a reverse orientation and comprises a DVD heavy chain amino acid sequence of SEQ ID NO. 577 and a DVD light chain amino acid sequence of SEQ ID NO: 578.

In an embodiment, the binding protein capable of binding VEGF (seq. 3) and DLL-4 (seq. 4) comprises a DVD heavy chain amino acid sequence selected from the group consisting of SEQ ID NO. 579 and SEQ ID NO. 581; and a DVD light chain amino acid sequence selected from the group consisting of SEQ ID NO. 580 and SEQ ID NO. 582. In an embodiment, the binding protein capable of binding VEGF (seq. 3) and DLL-4 (seq. 4) comprises a DVD heavy chain amino acid sequence of SEQ ID NO. 579 and a DVD light chain amino acid sequence of SEQ ID NO: 580. In another embodiment, the binding protein capable of binding VEGF (seq. 3) and DLL-4 (seq. 4) has a reverse orientation and comprises a DVD heavy chain amino acid sequence of SEQ ID NO. 581 and a DVD light chain amino acid sequence of SEQ ID NO: 582.

In a second embodiment, the binding protein capable of binding VEGF (seq. 3) and DLL-4 (seq. 4) comprises a DVD heavy chain amino acid sequence selected from the group consisting of SEQ ID NO. 583 and SEQ ID NO. 585; and a DVD light chain amino acid sequence selected from the group consisting of SEQ ID NO. 584 and SEQ ID NO. 586. In an embodiment, the binding protein capable of binding VEGF (seq. 3) and DLL-4 (seq. 4) comprises a DVD heavy chain amino acid sequence of SEQ ID NO. 583 and a DVD light chain amino acid sequence of SEQ ID NO: 584. In another embodiment, the binding protein capable of binding VEGF (seq. 3) and DLL-4 (seq. 4) has a reverse orientation and comprises a DVD heavy chain amino acid sequence of SEQ ID NO. 585 and a DVD light chain amino acid sequence of SEQ ID NO: 586.

In a third embodiment, the binding protein capable of binding VEGF (seq. 3) and DLL-4 (seq. 4) comprises a DVD heavy chain amino acid sequence selected from the group consisting of SEQ ID NO. 587 and SEQ ID NO. 589; and a DVD light chain amino acid sequence selected from the group consisting of SEQ ID NO. 588 and SEQ ID NO. 590. In an embodiment, the binding protein capable of binding VEGF (seq. 3) and DLL-4 (seq. 4) comprises a DVD heavy chain amino acid sequence of SEQ ID NO. 587 and a DVD light chain amino acid sequence of SEQ ID NO: 588. In another embodiment, the binding protein capable of binding VEGF (seq. 3) and DLL-4 (seq. 4) has a reverse orientation and comprises a DVD heavy chain amino acid sequence of SEQ ID NO. 589 and a DVD light chain amino acid sequence of SEQ ID NO: 590.

In a fourth embodiment, the binding protein capable of binding VEGF (seq. 3) and DLL-4 (seq. 4) comprises a DVD heavy chain amino acid sequence selected from the group consisting of SEQ ID NO. 591 and SEQ ID NO. 593; and a DVD light chain amino acid sequence selected from the group consisting of SEQ ID NO. 592 and SEQ ID NO. 594. In an embodiment, the binding protein capable of binding VEGF (seq. 3) and DLL-4 (seq. 4) comprises a DVD heavy chain amino acid sequence of SEQ ID NO. 591 and a DVD light chain amino acid sequence of SEQ ID NO: 592. In another embodiment, the binding protein capable of binding VEGF (seq. 3) and DLL-4 (seq. 4) has a reverse orientation and comprises a DVD heavy chain amino acid sequence of SEQ ID NO. 593 and a DVD light chain amino acid sequence of SEQ ID NO: 594.

In an embodiment, the binding protein capable of binding HER-2 (seq. 1) and ErbB3 (seq. 1) comprises a DVD heavy chain amino acid sequence selected from the group consisting of SEQ ID NO. 595 and SEQ ID NO. 597; and a DVD light chain amino acid sequence selected from the group consisting of SEQ ID NO. 596 and SEQ ID NO. 598. In an embodiment, the binding protein capable of binding HER-2 (seq. 1) and ErbB3 (seq. 1) comprises a DVD heavy chain amino acid sequence of SEQ ID NO. 595 and a DVD light chain amino acid sequence of SEQ ID NO: 596. In another embodiment, the binding protein capable of binding HER-2 (seq. 1) and ErbB3 (seq. 1) has a reverse orientation and comprises a DVD heavy chain amino acid sequence of SEQ ID NO. 597 and a DVD light chain amino acid sequence of SEQ ID NO: 598.

In a second embodiment, the binding protein capable of binding HER-2 (seq. 1) and ErbB3 (seq. 1) comprises a DVD heavy chain amino acid sequence selected from the group consisting of SEQ ID NO. 599 and SEQ ID NO. 601; and a DVD light chain amino acid sequence selected from the group consisting of SEQ ID NO. 600 and SEQ ID NO. 602. In an embodiment, the binding protein capable of binding HER-2 (seq. 1) and ErbB3 (seq. 1) comprises a DVD heavy chain amino acid sequence of SEQ ID NO. 599 and a DVD light chain amino acid sequence of SEQ ID NO: 600. In another embodiment, the binding protein capable of binding HER-2 (seq. 1) and ErbB3 (seq. 1) has a reverse orientation and comprises a DVD heavy chain amino acid sequence of SEQ ID NO. 601 and a DVD light chain amino acid sequence of SEQ ID NO: 602.

In a third embodiment, the binding protein capable of binding HER-2 (seq. 1) and ErbB3 (seq. 1) comprises a DVD heavy chain amino acid sequence selected from the group consisting of SEQ ID NO. 603 and SEQ ID NO. 605; and a DVD light chain amino acid sequence selected from the group consisting of SEQ ID NO. 604 and SEQ ID NO. 606. In an embodiment, the binding protein capable of binding HER-2 (seq. 1) and ErbB3 (seq. 1) comprises a DVD heavy chain amino acid sequence of SEQ ID NO. 603 and a DVD light chain amino acid sequence of SEQ ID NO: 604. In another embodiment, the binding protein capable of binding HER-2 (seq. 1) and ErbB3 (seq. 1) has a reverse orientation and comprises a DVD heavy chain amino acid sequence of SEQ ID NO. 605 and a DVD light chain amino acid sequence of SEQ ID NO: 606.

In a fourth embodiment, the binding protein capable of binding HER-2 (seq. 1) and ErbB3 (seq. 1) comprises a DVD heavy chain amino acid sequence selected from the group consisting of SEQ ID NO. 607 and SEQ ID NO. 609; and a DVD light chain amino acid sequence selected from the group consisting of SEQ ID NO. 608 and SEQ ID NO. 610. In an embodiment, the binding protein capable of binding HER-2 (seq. 1) and ErbB3 (seq. 1) comprises a DVD heavy chain amino acid sequence of SEQ ID NO. 607 and a DVD light chain amino acid sequence of SEQ ID NO: 608. In another embodiment, the binding protein capable of binding HER-2 (seq. 1) and ErbB3 (seq. 1) has a reverse orientation and comprises a DVD heavy chain amino acid sequence of SEQ ID NO. 609 and a DVD light chain amino acid sequence of SEQ ID NO: 610.

In an embodiment, the binding protein capable of binding HER-2 (seq. 1) and ErbB3 (seq. 2) comprises a DVD heavy chain amino acid sequence selected from the group consisting of SEQ ID NO. 611 and SEQ ID NO. 613; and a DVD light chain amino acid sequence selected from the group consisting of SEQ ID NO. 612 and SEQ ID NO. 614. In an embodiment, the binding protein capable of binding HER-2 (seq. 1) and ErbB3 (seq. 2) comprises a DVD heavy chain amino acid sequence of SEQ ID NO. 611 and a DVD light chain amino acid sequence of SEQ ID NO: 612. In another embodiment, the binding protein capable of binding HER-2 (seq. 1) and ErbB3 (seq. 2) has a reverse orientation and comprises a DVD heavy chain amino acid sequence of SEQ ID NO. 613 and a DVD light chain amino acid sequence of SEQ ID NO: 614.

In a second embodiment, the binding protein capable of binding HER-2 (seq. 1) and ErbB3 (seq. 2) comprises a DVD heavy chain amino acid sequence selected from the group consisting of SEQ ID NO. 615 and SEQ ID NO. 617; and a DVD light chain amino acid sequence selected from the group consisting of SEQ ID NO. 616 and SEQ ID NO. 618. In an embodiment, the binding protein capable of binding HER-2 (seq. 1) and ErbB3 (seq. 2) comprises a DVD heavy chain amino acid sequence of SEQ ID NO. 615 and a DVD light chain amino acid sequence of SEQ ID NO: 616. In another embodiment, the binding protein capable of binding HER-2 (seq. 1) and ErbB3 (seq. 2) has a reverse orientation and comprises a DVD heavy chain amino acid sequence of SEQ ID NO. 617 and a DVD light chain amino acid sequence of SEQ ID NO: 618.

In a third embodiment, the binding protein capable of binding HER-2 (seq. 1) and ErbB3 (seq. 2) comprises a DVD heavy chain amino acid sequence selected from the group consisting of SEQ ID NO. 619 and SEQ ID NO. 621; and a DVD light chain amino acid sequence selected from the group consisting of SEQ ID NO. 622 and SEQ ID NO. 624. In an embodiment, the binding protein capable of binding HER-2 (seq. 1) and ErbB3 (seq. 2) comprises a DVD heavy chain amino acid sequence of SEQ ID NO. 619 and a DVD light chain amino acid sequence of SEQ ID NO: 620. In another embodiment, the binding protein capable of binding HER-2 (seq. 1) and ErbB3 (seq. 2) has a reverse orientation and comprises a DVD heavy chain amino acid sequence of SEQ ID NO. 621 and a DVD light chain amino acid sequence of SEQ ID NO: 622.

In a fourth embodiment, the binding protein capable of binding HER-2 (seq. 1) and ErbB3 (seq. 2) comprises a DVD heavy chain amino acid sequence selected from the group consisting of SEQ ID NO. 623 and SEQ ID NO. 625; and a DVD light chain amino acid sequence selected from the group consisting of SEQ ID NO. 624 and SEQ ID NO. 626. In an embodiment, the binding protein capable of binding HER-2 (seq. 1) and ErbB3 (seq. 2) comprises a DVD heavy chain amino acid sequence of SEQ ID NO. 623 and a DVD light chain amino acid sequence of SEQ ID NO: 624. In another embodiment, the binding protein capable of binding HER-2 (seq. 1) and ErbB3 (seq. 2) has a reverse orientation and comprises a DVD heavy chain amino acid sequence of SEQ ID NO. 625 and a DVD light chain amino acid sequence of SEQ ID NO: 626.

In an embodiment, the binding protein capable of binding EGFR (seq. 2) and ErbB3 (seq. 3) comprises a DVD heavy chain amino acid sequence selected from the group consisting of SEQ ID NO. 627 and SEQ ID NO. 629; and a DVD light chain amino acid sequence selected from the group consisting of SEQ ID NO. 628 and SEQ ID NO. 630. In an embodiment, the binding protein capable of binding EGFR (seq. 2) and ErbB3 (seq. 3) comprises a DVD heavy chain amino acid sequence of SEQ ID NO. 627 and a DVD light chain amino acid sequence of SEQ ID NO: 628. In another embodiment, the binding protein capable of binding EGFR (seq. 2) and ErbB3 (seq. 3) has a reverse orientation and comprises a DVD heavy chain amino acid sequence of SEQ ID NO. 629 and a DVD light chain amino acid sequence of SEQ ID NO: 630.

In a second embodiment, the binding protein capable of binding EGFR (seq. 2) and ErbB3 (seq. 3) comprises a DVD heavy chain amino acid sequence selected from the group consisting of SEQ ID NO. 631 and SEQ ID NO. 633; and a DVD light chain amino acid sequence selected from the group consisting of SEQ ID NO. 632 and SEQ ID NO. 634. In an embodiment, the binding protein capable of binding EGFR (seq. 2) and ErbB3 (seq. 3) comprises a DVD heavy chain amino acid sequence of SEQ ID NO. 631 and a DVD light chain amino acid sequence of SEQ ID NO: 632. In another embodiment, the binding protein capable of binding EGFR (seq. 2) and ErbB3 (seq. 3) has a reverse orientation and comprises a DVD heavy chain amino acid sequence of SEQ ID NO. 633 and a DVD light chain amino acid sequence of SEQ ID NO: 634.

In a third embodiment, the binding protein capable of binding EGFR (seq. 2) and ErbB3 (seq. 3) comprises a DVD heavy chain amino acid sequence selected from the group consisting of SEQ ID NO. 635 and SEQ ID NO. 637; and a DVD light chain amino acid sequence selected from the group consisting of SEQ ID NO. 636 and SEQ ID NO. 638. In an embodiment, the binding protein capable of binding EGFR (seq. 2) and ErbB3 (seq. 3) comprises a DVD heavy chain amino acid sequence of SEQ ID NO. 635 and a DVD light chain amino acid sequence of SEQ ID NO: 636. In another embodiment, the binding protein capable of binding EGFR (seq. 2) and ErbB3 (seq. 3) has a reverse orientation and comprises a DVD heavy chain amino acid sequence of SEQ ID NO. 637 and a DVD light chain amino acid sequence of SEQ ID NO: 638.

In a fourth embodiment, the binding protein capable of binding EGFR (seq. 2) and ErbB3 (seq. 3) comprises a DVD heavy chain amino acid sequence selected from the group consisting of SEQ ID NO. 639 and SEQ ID NO. 641; and a DVD light chain amino acid sequence selected from the group consisting of SEQ ID NO. 640 and SEQ ID NO. 642. In an embodiment, the binding protein capable of binding EGFR (seq. 2) and ErbB3 (seq. 3) comprises a DVD heavy chain amino acid sequence of SEQ ID NO. 639 and a DVD light chain amino acid sequence of SEQ ID NO: 640. In another embodiment, the binding protein capable of binding EGFR (seq. 2) and ErbB3 (seq. 3) has a reverse orientation and comprises a DVD heavy chain amino acid sequence of SEQ ID NO. 641 and a DVD light chain amino acid sequence of SEQ ID NO: 642.

In an embodiment, the binding protein capable of binding HER-2 (seq. 1) and ErbB3 (seq. 3) comprises a DVD heavy chain amino acid sequence selected from the group consisting of SEQ ID NO. 643 and SEQ ID NO. 645; and a DVD light chain amino acid sequence selected from the group consisting of SEQ ID NO. 644 and SEQ ID NO. 646. In an embodiment, the binding protein capable of binding HER-2 (seq. 1) and ErbB3 (seq. 3) comprises a DVD heavy chain amino acid sequence of SEQ ID NO. 643 and a DVD light chain amino acid sequence of SEQ ID NO: 644. In another embodiment, the binding protein capable of binding HER-2 (seq. 1) and ErbB3 (seq. 3) has a reverse orientation and comprises a DVD heavy chain amino acid sequence of SEQ ID NO. 645 and a DVD light chain amino acid sequence of SEQ ID NO: 646.

In a second embodiment, the binding protein capable of binding HER-2 (seq. 1) and ErbB3 (seq. 3) comprises a DVD heavy chain amino acid sequence selected from the group consisting of SEQ ID NO. 647 and SEQ ID NO. 649; and a DVD light chain amino acid sequence selected from the group consisting of SEQ ID NO. 648 and SEQ ID NO. 650. In an embodiment, the binding protein capable of binding HER-2 (seq. 1) and ErbB3 (seq. 3) comprises a DVD heavy chain amino acid sequence of SEQ ID NO. 647 and a DVD light chain amino acid sequence of SEQ ID NO: 648. In another embodiment, the binding protein capable of binding HER-2 (seq. 1) and ErbB3 (seq. 3) has a reverse orientation and comprises a DVD heavy chain amino acid sequence of SEQ ID NO. 649 and a DVD light chain amino acid sequence of SEQ ID NO: 650.

In a third embodiment, the binding protein capable of binding HER-2 (seq. 1) and ErbB3 (seq. 3) comprises a DVD heavy chain amino acid sequence selected from the group consisting of SEQ ID NO. 651 and SEQ ID NO. 653; and a DVD light chain amino acid sequence selected from the group consisting of SEQ ID NO. 652 and SEQ ID NO. 654. In an embodiment, the binding protein capable of binding HER-2 (seq. 1) and ErbB3 (seq. 3) comprises a DVD heavy chain amino acid sequence of SEQ ID NO. 651 and a DVD light chain amino acid sequence of SEQ ID NO: 652. In another embodiment, the binding protein capable of binding HER-2 (seq. 1) and ErbB3 (seq. 3) has a reverse orientation and comprises a DVD heavy chain amino acid sequence of SEQ ID NO. 653 and a DVD light chain amino acid sequence of SEQ ID NO: 654.

In a fourth embodiment, the binding protein capable of binding HER-2 (seq. 1) and ErbB3 (seq. 3) comprises a DVD heavy chain amino acid sequence selected from the group consisting of SEQ ID NO. 655 and SEQ ID NO. 657; and a DVD light chain amino acid sequence selected from the group consisting of SEQ ID NO. 656 and SEQ ID NO. 658. In an embodiment, the binding protein capable of binding HER-2 (seq. 1) and ErbB3 (seq. 3) comprises a DVD heavy chain amino acid sequence of SEQ ID NO. 655 and a DVD light chain amino acid sequence of SEQ ID NO: 656. In another embodiment, the binding protein capable of binding HER-2 (seq. 1) and ErbB3 (seq. 3) has a reverse orientation and comprises a DVD heavy chain amino acid sequence of SEQ ID NO. 657 and a DVD light chain amino acid sequence of SEQ ID NO: 658.

In an embodiment, the binding protein capable of binding VEGF (seq. 1) and PLGF (seq. 2) comprises a DVD heavy chain amino acid sequence selected from the group consisting of SEQ ID NO. 659 and SEQ ID NO. 661; and a DVD light chain amino acid sequence selected from the group consisting of SEQ ID NO. 660 and SEQ ID NO. 662. In an embodiment, the binding protein capable of binding VEGF (seq. 1) and PLGF (seq. 2) comprises a DVD heavy chain amino acid sequence of SEQ ID NO. 659 and a DVD light chain amino acid sequence of SEQ ID NO: 660. In another embodiment, the binding protein capable of binding VEGF (seq. 1) and PLGF (seq. 2) has a reverse orientation and comprises a DVD heavy chain amino acid sequence of SEQ ID NO. 661 and a DVD light chain amino acid sequence of SEQ ID NO: 662.

In a second embodiment, the binding protein capable of binding VEGF (seq. 1) and PLGF (seq. 2) comprises a DVD heavy chain amino acid sequence selected from the group consisting of SEQ ID NO. 663 and SEQ ID NO. 665; and a DVD light chain amino acid sequence selected from the group consisting of SEQ ID NO. 664 and SEQ ID NO. 666. In an embodiment, the binding protein capable of binding VEGF (seq. 1) and PLGF (seq. 2) comprises a DVD heavy chain amino acid sequence of SEQ ID NO. 663 and a DVD light chain amino acid sequence of SEQ ID NO: 664. In another embodiment, the binding protein capable of binding VEGF (seq. 1) and PLGF (seq. 2) has a reverse orientation and comprises a DVD heavy chain amino acid sequence of SEQ ID NO. 665 and a DVD light chain amino acid sequence of SEQ ID NO: 666.

In a third embodiment, the binding protein capable of binding VEGF (seq. 1) and PLGF (seq. 2) comprises a DVD heavy chain amino acid sequence selected from the group consisting of SEQ ID NO. 667 and SEQ ID NO. 669; and a DVD light chain amino acid sequence selected from the group consisting of SEQ ID NO. 668 and SEQ ID NO. 670. In an embodiment, the binding protein capable of binding VEGF (seq. 1) and PLGF (seq. 2) comprises a DVD heavy chain amino acid sequence of SEQ ID NO. 667 and a DVD light chain amino acid sequence of SEQ ID NO: 668. In another embodiment, the binding protein capable of binding VEGF (seq. 1) and PLGF (seq. 2) has a reverse orientation and comprises a DVD heavy chain amino acid sequence of SEQ ID NO. 669 and a DVD light chain amino acid sequence of SEQ ID NO: 670.

In a fourth embodiment, the binding protein capable of binding VEGF (seq. 1) and PLGF (seq. 2) comprises a DVD heavy chain amino acid sequence selected from the group consisting of SEQ ID NO. 671 and SEQ ID NO. 673; and a DVD light chain amino acid sequence selected from the group consisting of SEQ ID NO. 672 and SEQ ID NO. 674. In an embodiment, the binding protein capable of binding VEGF (seq. 1) and PLGF (seq. 2) comprises a DVD heavy chain amino acid sequence of SEQ ID NO. 671 and a DVD light chain amino acid sequence of SEQ ID NO: 672. In another embodiment, the binding protein capable of binding VEGF (seq. 1) and PLGF (seq. 2) has a reverse orientation and comprises a DVD heavy chain amino acid sequence of SEQ ID NO. 673 and a DVD light chain amino acid sequence of SEQ ID NO: 674.

In an embodiment, the binding protein capable of binding VEGF (seq. 2) and PLGF (seq. 2) comprises a DVD heavy chain amino acid sequence selected from the group consisting of SEQ ID NO. 675 and SEQ ID NO. 677; and a DVD light chain amino acid sequence selected from the group consisting of SEQ ID NO. 676 and SEQ ID NO. 678. In an embodiment, the binding protein capable of binding VEGF (seq. 2) and PLGF (seq. 2) comprises a DVD heavy chain amino acid sequence of SEQ ID NO. 675 and a DVD light chain amino acid sequence of SEQ ID NO: 676. In another embodiment, the binding protein capable of binding VEGF (seq. 2) and PLGF (seq. 2) has a reverse orientation and comprises a DVD heavy chain amino acid sequence of SEQ ID NO. 677 and a DVD light chain amino acid sequence of SEQ ID NO: 678.

In a second embodiment, the binding protein capable of binding VEGF (seq. 2) and PLGF (seq. 2) comprises a DVD heavy chain amino acid sequence selected from the group consisting of SEQ ID NO. 679 and SEQ ID NO. 681; and a DVD light chain amino acid sequence selected from the group consisting of SEQ ID NO. 680 and SEQ ID NO. 682. In an embodiment, the binding protein capable of binding VEGF (seq. 2) and PLGF (seq. 2) comprises a DVD heavy chain amino acid sequence of SEQ ID NO. 679 and a DVD light chain amino acid sequence of SEQ ID NO: 680. In another embodiment, the binding protein capable of binding VEGF (seq. 2) and PLGF (seq. 2) has a reverse orientation and comprises a DVD heavy chain amino acid sequence of SEQ ID NO. 681 and a DVD light chain amino acid sequence of SEQ ID NO: 682.

In a third embodiment, the binding protein capable of binding VEGF (seq. 2) and PLGF (seq. 2) comprises a DVD heavy chain amino acid sequence selected from the group consisting of SEQ ID NO. 683 and SEQ ID NO. 685; and a DVD light chain amino acid sequence selected from the group consisting of SEQ ID NO. 684 and SEQ ID NO. 686. In an embodiment, the binding protein capable of binding VEGF (seq. 2) and PLGF (seq. 2) comprises a DVD heavy chain amino acid sequence of SEQ ID NO. 683 and a DVD light chain amino acid sequence of SEQ ID NO: 684. In another embodiment, the binding protein capable of binding VEGF (seq. 2) and PLGF (seq. 2) has a reverse orientation and comprises a DVD heavy chain amino acid sequence of SEQ ID NO. 685 and a DVD light chain amino acid sequence of SEQ ID NO: 686.

In a fourth embodiment, the binding protein capable of binding VEGF (seq. 2) and PLGF (seq. 2) comprises a DVD heavy chain amino acid sequence selected from the group consisting of SEQ ID NO. 687 and SEQ ID NO. 689; and a DVD light chain amino acid sequence selected from the group consisting of SEQ ID NO. 688 and SEQ ID NO. 690. In an embodiment, the binding protein capable of binding VEGF (seq. 2) and PLGF (seq. 2) comprises a DVD heavy chain amino acid sequence of SEQ ID NO. 687 and a DVD light chain amino acid sequence of SEQ ID NO: 688. In another embodiment, the binding protein capable of binding VEGF (seq. 2) and PLGF (seq. 2) has a reverse orientation and comprises a DVD heavy chain amino acid sequence of SEQ ID NO. 689 and a DVD light chain amino acid sequence of SEQ ID NO: 690.

In an embodiment, the binding protein capable of binding VEGF (seq. 3) and PLGF (seq. 2) comprises a DVD heavy chain amino acid sequence selected from the group consisting of SEQ ID NO. 691 and SEQ ID NO. 693; and a DVD light chain amino acid sequence selected from the group consisting of SEQ ID NO. 692 and SEQ ID NO. 694. In an embodiment, the binding protein capable of binding VEGF (seq. 3) and PLGF (seq. 2) comprises a DVD heavy chain amino acid sequence of SEQ ID NO. 691 and a DVD light chain amino acid sequence of SEQ ID NO: 692. In another embodiment, the binding protein capable of binding VEGF (seq. 3) and PLGF (seq. 2) has a reverse orientation and comprises a DVD heavy chain amino acid sequence of SEQ ID NO. 693 and a DVD light chain amino acid sequence of SEQ ID NO: 694

In a second embodiment, the binding protein capable of binding VEGF (seq. 3) and PLGF (seq. 2) comprises a DVD heavy chain amino acid sequence selected from the group consisting of SEQ ID NO. 695 and SEQ ID NO. 697; and a DVD light chain amino acid sequence selected from the group consisting of SEQ ID NO. 696 and SEQ ID NO. 698. In an embodiment, the binding protein capable of binding VEGF (seq. 3) and PLGF (seq. 2) comprises a DVD heavy chain amino acid sequence of SEQ ID NO. 695 and a DVD light chain amino acid sequence of SEQ ID NO: 696. In another embodiment, the binding protein capable of binding VEGF (seq. 3) and PLGF (seq. 2) has a reverse orientation and comprises a DVD heavy chain amino acid sequence of SEQ ID NO. 697 and a DVD light chain amino acid sequence of SEQ ID NO: 698.

In a third embodiment, the binding protein capable of binding VEGF (seq. 3) and PLGF (seq. 2) comprises a DVD heavy chain amino acid sequence selected from the group consisting of SEQ ID NO. 699 and SEQ ID NO. 701; and a DVD light chain amino acid sequence selected from the group consisting of SEQ ID NO. 700 and SEQ ID NO. 702. In an embodiment, the binding protein capable of binding VEGF (seq. 3) and PLGF (seq. 2) comprises a DVD heavy chain amino acid sequence of SEQ ID NO. 699 and a DVD light chain amino acid sequence of SEQ ID NO: 700. In another embodiment, the binding protein capable of binding VEGF (seq. 3) and PLGF (seq. 2) has a reverse orientation and comprises a DVD heavy chain amino acid sequence of SEQ ID NO. 701 and a DVD light chain amino acid sequence of SEQ ID NO: 702.

In a fourth embodiment, the binding protein capable of binding VEGF (seq. 3) and PLGF (seq. 2) comprises a DVD heavy chain amino acid sequence selected from the group consisting of SEQ ID NO. 703 and SEQ ID NO. 705; and a DVD light chain amino acid sequence selected from the group consisting of SEQ ID NO. 704 and SEQ ID NO. 706. In an embodiment, the binding protein capable of binding VEGF (seq. 3) and PLGF (seq. 2) comprises a DVD heavy chain amino acid sequence of SEQ ID NO. 703 and a DVD light chain amino acid sequence of SEQ ID NO: 704. In another embodiment, the binding protein capable of binding VEGF (seq. 3) and PLGF (seq. 2) has a reverse orientation and comprises a DVD heavy chain amino acid sequence of SEQ ID NO. 705 and a DVD light chain amino acid sequence of SEQ ID NO: 706.

In an embodiment, the binding protein capable of binding HER-2 (seq. 1) and PLGF (seq. 2) comprises a DVD heavy chain amino acid sequence selected from the group consisting of SEQ ID NO. 707 and SEQ ID NO. 709; and a DVD light chain amino acid sequence selected from the group consisting of SEQ ID NO. 708 and SEQ ID NO. 710. In an embodiment, the binding protein capable of binding HER-2 (seq. 1) and PLGF (seq. 2) comprises a DVD heavy chain amino acid sequence of SEQ ID NO. 707 and a DVD light chain amino acid sequence of SEQ ID NO: 708. In another embodiment, the binding protein capable of binding HER-2 (seq. 1) and PLGF (seq. 2) has a reverse orientation and comprises a DVD heavy chain amino acid sequence of SEQ ID NO. 709 and a DVD light chain amino acid sequence of SEQ ID NO: 710.

In a second embodiment, the binding protein capable of binding HER-2 (seq. 1) and PLGF (seq. 2) comprises a DVD heavy chain amino acid sequence selected from the group consisting of SEQ ID NO. 711 and SEQ ID NO. 713; and a DVD light chain amino acid sequence selected from the group consisting of SEQ ID NO. 712 and SEQ ID NO. 714. In an embodiment, the binding protein capable of binding HER-2 (seq. 1) and PLGF (seq. 2) comprises a DVD heavy chain amino acid sequence of SEQ ID NO. 711 and a DVD light chain amino acid sequence of SEQ ID NO: 712. In another embodiment, the binding protein capable of binding HER-2 (seq. 1) and PLGF (seq. 2) has a reverse orientation and comprises a DVD heavy chain amino acid sequence of SEQ ID NO. 713 and a DVD light chain amino acid sequence of SEQ ID NO: 714.

In a third embodiment, the binding protein capable of binding HER-2 (seq. 1) and PLGF (seq. 2) comprises a DVD heavy chain amino acid sequence selected from the group consisting of SEQ ID NO. 715 and SEQ ID NO. 717; and a DVD light chain amino acid sequence selected from the group consisting of SEQ ID NO. 716 and SEQ ID NO. 718. In an embodiment, the binding protein capable of binding HER-2 (seq. 1) and PLGF (seq. 2) comprises a DVD heavy chain amino acid sequence of SEQ ID NO. 715 and a DVD light chain amino acid sequence of SEQ ID NO: 716. In another embodiment, the binding protein capable of binding HER-2 (seq. 1) and PLGF (seq. 2) has a reverse orientation and comprises a DVD heavy chain amino acid sequence of SEQ ID NO. 717 and a DVD light chain amino acid sequence of SEQ ID NO: 718.

In a fourth embodiment, the binding protein capable of binding HER-2 (seq. 1) and PLGF (seq. 2) comprises a DVD heavy chain amino acid sequence selected from the group consisting of SEQ ID NO. 719 and SEQ ID NO. 721; and a DVD light chain amino acid sequence selected from the group consisting of SEQ ID NO. 720 and SEQ ID NO. 722. In an embodiment, the binding protein capable of binding HER-2 (seq. 1) and PLGF (seq. 2) comprises a DVD heavy chain amino acid sequence of SEQ ID NO. 719 and a DVD light chain amino acid sequence of SEQ ID NO: 720. In another embodiment, the binding protein capable of binding HER-2 (seq. 1) and PLGF (seq. 2) has a reverse orientation and comprises a DVD heavy chain amino acid sequence of SEQ ID NO. 721 and a DVD light chain amino acid sequence of SEQ ID NO: 722.

In an embodiment, the binding protein capable of binding PLGF (seq. 1) and VEGF (seq. 2) comprises a DVD heavy chain amino acid sequence selected from the group consisting of SEQ ID NO. 723 and SEQ ID NO. 725; and a DVD light chain amino acid sequence selected from the group consisting of SEQ ID NO. 724 and SEQ ID NO. 726. In an embodiment, the binding protein capable of binding PLGF (seq. 1) and VEGF (seq. 2) comprises a DVD heavy chain amino acid sequence of SEQ ID NO. 723 and a DVD light chain amino acid sequence of SEQ ID NO: 724. In another embodiment, the binding protein capable of binding PLGF (seq. 1) and VEGF (seq. 2) has a reverse orientation and comprises a DVD heavy chain amino acid sequence of SEQ ID NO. 725 and a DVD light chain amino acid sequence of SEQ ID NO: 726.

In a second embodiment, the binding protein capable of binding PLGF (seq. 1) and VEGF (seq. 2) comprises a DVD heavy chain amino acid sequence selected from the group consisting of SEQ ID NO. 727 and SEQ ID NO. 729; and a DVD light chain amino acid sequence selected from the group consisting of SEQ ID NO. 728 and SEQ ID NO. 730. In an embodiment, the binding protein capable of binding PLGF (seq. 1) and VEGF (seq. 2) comprises a DVD heavy chain amino acid sequence of SEQ ID NO. 727 and a DVD light chain amino acid sequence of SEQ ID NO: 728. In another embodiment, the binding protein capable of binding PLGF (seq. 1) and VEGF (seq. 2) has a reverse orientation and comprises a DVD heavy chain amino acid sequence of SEQ ID NO. 729 and a DVD light chain amino acid sequence of SEQ ID NO: 730.

In a third embodiment, the binding protein capable of binding PLGF (seq. 1) and VEGF (seq. 2) comprises a DVD heavy chain amino acid sequence selected from the group consisting of SEQ ID NO. 731 and SEQ ID NO. 733; and a DVD light chain amino acid sequence selected from the group consisting of SEQ ID NO. 732 and SEQ ID NO. 734. In an embodiment, the binding protein capable of binding PLGF (seq. 1) and VEGF (seq. 2) comprises a DVD heavy chain amino acid sequence of SEQ ID NO. 731 and a DVD light chain amino acid sequence of SEQ ID NO: 732. In another embodiment, the binding protein capable of binding PLGF (seq. 1) and VEGF (seq. 2) has a reverse orientation and comprises a DVD heavy chain amino acid sequence of SEQ ID NO. 733 and a DVD light chain amino acid sequence of SEQ ID NO: 734.

In a fourth embodiment, the binding protein capable of binding PLGF (seq. 1) and VEGF (seq. 2) comprises a DVD heavy chain amino acid sequence selected from the group consisting of SEQ ID NO. 735 and SEQ ID NO. 737; and a DVD light chain amino acid sequence selected from the group consisting of SEQ ID NO. 736 and SEQ ID NO. 738. In an embodiment, the binding protein capable of binding PLGF (seq. 1) and VEGF (seq. 2) comprises a DVD heavy chain amino acid sequence of SEQ ID NO. 735 and a DVD light chain amino acid sequence of SEQ ID NO: 736. In another embodiment, the binding protein capable of binding PLGF (seq. 1) and VEGF (seq. 2) has a reverse orientation and comprises a DVD heavy chain amino acid sequence of SEQ ID NO. 737 and a DVD light chain amino acid sequence of SEQ ID NO: 738.

In an embodiment, the binding protein capable of binding PLGF (seq. 1) and VEGF (seq. 3) comprises a DVD heavy chain amino acid sequence selected from the group consisting of SEQ ID NO. 739 and SEQ ID NO. 741; and a DVD light chain amino acid sequence selected from the group consisting of SEQ ID NO. 740 and SEQ ID NO. 742. In an embodiment, the binding protein capable of binding PLGF (seq. 1) and VEGF (seq. 3) comprises a DVD heavy chain amino acid sequence of SEQ ID NO. 739 and a DVD light chain amino acid sequence of SEQ ID NO: 740. In another embodiment, the binding protein capable of binding PLGF (seq. 1) and VEGF (seq. 3) has a reverse orientation and comprises a DVD heavy chain amino acid sequence of SEQ ID NO. 741 and a DVD light chain amino acid sequence of SEQ ID NO: 742.

In a second embodiment, the binding protein capable of binding PLGF (seq. 1) and VEGF (seq. 3) comprises a DVD heavy chain amino acid sequence selected from the group consisting of SEQ ID NO. 743 and SEQ ID NO. 745; and a DVD light chain amino acid sequence selected from the group consisting of SEQ ID NO. 744 and SEQ ID NO. 746. In an embodiment, the binding protein capable of binding PLGF (seq. 1) and VEGF (seq. 3) comprises a DVD heavy chain amino acid sequence of SEQ ID NO. 743 and a DVD light chain amino acid sequence of SEQ ID NO: 744. In another embodiment, the binding protein capable of binding PLGF (seq. 1) and VEGF (seq. 3) has a reverse orientation and comprises a DVD heavy chain amino acid sequence of SEQ ID NO. 745 and a DVD light chain amino acid sequence of SEQ ID NO: 746.

In a third embodiment, the binding protein capable of binding PLGF (seq. 1) and VEGF (seq. 3) comprises a DVD heavy chain amino acid sequence selected from the group consisting of SEQ ID NO. 747 and SEQ ID NO. 749; and a DVD light chain amino acid sequence selected from the group consisting of SEQ ID NO. 748 and SEQ ID NO. 750. In an embodiment, the binding protein capable of binding PLGF (seq. 1) and VEGF (seq. 3) comprises a DVD heavy chain amino acid sequence of SEQ ID NO. 747 and a DVD light chain amino acid sequence of SEQ ID NO: 748. In another embodiment, the binding protein capable of binding PLGF (seq. 1) and VEGF (seq. 3) has a reverse orientation and comprises a DVD heavy chain amino acid sequence of SEQ ID NO. 749 and a DVD light chain amino acid sequence of SEQ ID NO: 750.

In a fourth embodiment, the binding protein capable of binding PLGF (seq. 1) and VEGF (seq. 3) comprises a DVD heavy chain amino acid sequence selected from the group consisting of SEQ ID NO. 751 and SEQ ID NO. 753; and a DVD light chain amino acid sequence selected from the group consisting of SEQ ID NO. 752 and SEQ ID NO. 754. In an embodiment, the binding protein capable of binding PLGF (seq. 1) and VEGF (seq. 3) comprises a DVD heavy chain amino acid sequence of SEQ ID NO. 751 and a DVD light chain amino acid sequence of SEQ ID NO: 752. In another embodiment, the binding protein capable of binding PLGF (seq. 1) and VEGF (seq. 3) has a reverse orientation and comprises a DVD heavy chain amino acid sequence of SEQ ID NO. 753 and a DVD light chain amino acid sequence of SEQ ID NO: 754.

In an embodiment, the binding protein capable of binding HER-2 (seq. 1) and PLGF (seq. 1) comprises a DVD heavy chain amino acid sequence selected from the group consisting of SEQ ID NO. 755 and SEQ ID NO. 757; and a DVD light chain amino acid sequence selected from the group consisting of SEQ ID NO. 756 and SEQ ID NO. 758. In an embodiment, the binding protein capable of binding HER-2 (seq. 1) and PLGF (seq. 1) comprises a DVD heavy chain amino acid sequence of SEQ ID NO. 755 and a DVD light chain amino acid sequence of SEQ ID NO: 756. In another embodiment, the binding protein capable of binding HER-2 (seq. 1) and PLGF (seq. 1) has a reverse orientation and comprises a DVD heavy chain amino acid sequence of SEQ ID NO. 757 and a DVD light chain amino acid sequence of SEQ ID NO: 758.

In a second embodiment, the binding protein capable of binding HER-2 (seq. 1) and PLGF (seq. 1) comprises a DVD heavy chain amino acid sequence selected from the group consisting of SEQ ID NO. 759 and SEQ ID NO. 761; and a DVD light chain amino acid sequence selected from the group consisting of SEQ ID NO. 760 and SEQ ID NO. 762. In an embodiment, the binding protein capable of binding HER-2 (seq. 1) and PLGF (seq. 1) comprises a DVD heavy chain amino acid sequence of SEQ ID NO. 759 and a DVD light chain amino acid sequence of SEQ ID NO: 760. In another embodiment, the binding protein capable of binding HER-2 (seq. 1) and PLGF (seq. 1) has a reverse orientation and comprises a DVD heavy chain amino acid sequence of SEQ ID NO. 761 and a DVD light chain amino acid sequence of SEQ ID NO: 762.

In a third embodiment, the binding protein capable of binding HER-2 (seq. 1) and PLGF (seq. 1) comprises a DVD heavy chain amino acid sequence selected from the group consisting of SEQ ID NO. 763 and SEQ ID NO. 765; and a DVD light chain amino acid sequence selected from the group consisting of SEQ ID NO. 764 and SEQ ID NO. 766. In an embodiment, the binding protein capable of binding HER-2 (seq. 1) and PLGF (seq. 1) comprises a DVD heavy chain amino acid sequence of SEQ ID NO. 763 and a DVD light chain amino acid sequence of SEQ ID NO: 764. In another embodiment, the binding protein capable of binding HER-2 (seq. 1) and PLGF (seq. 1) has a reverse orientation and comprises a DVD heavy chain amino acid sequence of SEQ ID NO. 765 and a DVD light chain amino acid sequence of SEQ ID NO: 766.

In a fourth embodiment, the binding protein capable of binding HER-2 (seq. 1) and PLGF (seq. 1) comprises a DVD heavy chain amino acid sequence selected from the group consisting of SEQ ID NO. 767 and SEQ ID NO. 769; and a DVD light chain amino acid sequence selected from the group consisting of SEQ ID NO. 768 and SEQ ID NO. 770. In an embodiment, the binding protein capable of binding HER-2 (seq. 1) and PLGF (seq. 1) comprises a DVD heavy chain amino acid sequence of SEQ ID NO. 767 and a DVD light chain amino acid sequence of SEQ ID NO: 768. In another embodiment, the binding protein capable of binding HER-2 (seq. 1) and PLGF (seq. 1) has a reverse orientation and comprises a DVD heavy chain amino acid sequence of SEQ ID NO. 769 and a DVD light chain amino acid sequence of SEQ ID NO: 770.

In an embodiment, the binding protein capable of binding HGF (seq. 1) and VEGF (seq. 2) comprises a DVD heavy chain amino acid sequence selected from the group consisting of SEQ ID NO. 771 and SEQ ID NO. 773; and a DVD light chain amino acid sequence selected from the group consisting of SEQ ID NO. 772 and SEQ ID NO. 774. In an embodiment, the binding protein capable of binding HGF (seq. 1) and VEGF (seq. 2) comprises a DVD heavy chain amino acid sequence of SEQ ID NO. 771 and a DVD light chain amino acid sequence of SEQ ID NO: 772. In another embodiment, the binding protein capable of binding HGF (seq. 1) and VEGF (seq. 2) has a reverse orientation and comprises a DVD heavy chain amino acid sequence of SEQ ID NO. 773 and a DVD light chain amino acid sequence of SEQ ID NO: 774.

In a second embodiment, the binding protein capable of binding HGF (seq. 1) and VEGF (seq. 2) comprises a DVD heavy chain amino acid sequence selected from the group consisting of SEQ ID NO. 775 and SEQ ID NO. 777; and a DVD light chain amino acid sequence selected from the group consisting of SEQ ID NO. 776 and SEQ ID NO. 778. In an embodiment, the binding protein capable of binding HGF (seq. 1) and VEGF (seq. 2) comprises a DVD heavy chain amino acid sequence of SEQ ID NO. 775 and a DVD light chain amino acid sequence of SEQ ID NO: 776. In another embodiment, the binding protein capable of binding HGF (seq. 1) and VEGF (seq. 2) has a reverse orientation and comprises a DVD heavy chain amino acid sequence of SEQ ID NO. 777 and a DVD light chain amino acid sequence of SEQ ID NO: 778.

In a third embodiment, the binding protein capable of binding HGF (seq. 1) and VEGF (seq. 2) comprises a DVD heavy chain amino acid sequence selected from the group consisting of SEQ ID NO. 779 and SEQ ID NO. 781; and a DVD light chain amino acid sequence selected from the group consisting of SEQ ID NO. 780 and SEQ ID NO. 782. In an embodiment, the binding protein capable of binding HGF (seq. 1) and VEGF (seq. 2) comprises a DVD heavy chain amino acid sequence of SEQ ID NO. 779 and a DVD light chain amino acid sequence of SEQ ID NO: 780. In another embodiment, the binding protein capable of binding HGF (seq. 1) and VEGF (seq. 2) has a reverse orientation and comprises a DVD heavy chain amino acid sequence of SEQ ID NO. 781 and a DVD light chain amino acid sequence of SEQ ID NO: 782.

In a fourth embodiment, the binding protein capable of binding HGF (seq. 1) and VEGF (seq. 2) comprises a DVD heavy chain amino acid sequence selected from the group consisting of SEQ ID NO. 783 and SEQ ID NO. 785; and a DVD light chain amino acid sequence selected from the group consisting of SEQ ID NO. 784 and SEQ ID NO. 786. In an embodiment, the binding protein capable of binding HGF (seq. 1) and VEGF (seq. 2) comprises a DVD heavy chain amino acid sequence of SEQ ID NO. 783 and a DVD light chain amino acid sequence of SEQ ID NO: 784. In another embodiment, the binding protein capable of binding HGF (seq. 1) and VEGF (seq. 2) has a reverse orientation and comprises a DVD heavy chain amino acid sequence of SEQ ID NO. 785 and a DVD light chain amino acid sequence of SEQ ID NO: 786.

In an embodiment, the binding protein capable of binding HGF (seq. 1) and VEGF (seq. 3) comprises a DVD heavy chain amino acid sequence selected from the group consisting of SEQ ID NO. 787 and SEQ ID NO. 789; and a DVD light chain amino acid sequence selected from the group consisting of SEQ ID NO. 788 and SEQ ID NO. 790. In an embodiment, the binding protein capable of binding HGF (seq. 1) and VEGF (seq. 3) comprises a DVD heavy chain amino acid sequence of SEQ ID NO. 787 and a DVD light chain amino acid sequence of SEQ ID NO: 788. In another embodiment, the binding protein capable of binding HGF (seq. 1) and VEGF (seq. 3) has a reverse orientation and comprises a DVD heavy chain amino acid sequence of SEQ ID NO. 789 and a DVD light chain amino acid sequence of SEQ ID NO: 790.

In a second embodiment, the binding protein capable of binding HGF (seq. 1) and VEGF (seq. 3) comprises a DVD heavy chain amino acid sequence selected from the group consisting of SEQ ID NO. 791 and SEQ ID NO. 793; and a DVD light chain amino acid sequence selected from the group consisting of SEQ ID NO. 792 and SEQ ID NO. 794. In an embodiment, the binding protein capable of binding HGF (seq. 1) and VEGF (seq. 3) comprises a DVD heavy chain amino acid sequence of SEQ ID NO. 791 and a DVD light chain amino acid sequence of SEQ ID NO: 792. In another embodiment, the binding protein capable of binding HGF (seq. 1) and VEGF (seq. 3) has a reverse orientation and comprises a DVD heavy chain amino acid sequence of SEQ ID NO. 793 and a DVD light chain amino acid sequence of SEQ ID NO: 794.

In a third embodiment, the binding protein capable of binding HGF (seq. 1) and VEGF (seq. 3) comprises a DVD heavy chain amino acid sequence selected from the group consisting of SEQ ID NO. 795 and SEQ ID NO. 797; and a DVD light chain amino acid sequence selected from the group consisting of SEQ ID NO. 796 and SEQ ID NO. 798. In an embodiment, the binding protein capable of binding HGF (seq. 1) and VEGF (seq. 3) comprises a DVD heavy chain amino acid sequence of SEQ ID NO. 795 and a DVD light chain amino acid sequence of SEQ ID NO: 796. In another embodiment, the binding protein capable of binding HGF (seq. 1) and VEGF (seq. 3) has a reverse orientation and comprises a DVD heavy chain amino acid sequence of SEQ ID NO. 797 and a DVD light chain amino acid sequence of SEQ ID NO: 798.

In a fourth embodiment, the binding protein capable of binding HGF (seq. 1) and VEGF (seq. 3) comprises a DVD heavy chain amino acid sequence selected from the group consisting of SEQ ID NO. 799 and SEQ ID NO. 801; and a DVD light chain amino acid sequence selected from the group consisting of SEQ ID NO. 800 and SEQ ID NO. 802. In an embodiment, the binding protein capable of binding HGF (seq. 1) and VEGF (seq. 3) comprises a DVD heavy chain amino acid sequence of SEQ ID NO. 799 and a DVD light chain amino acid sequence of SEQ ID NO: 800. In another embodiment, the binding protein capable of binding HGF (seq. 1) and VEGF (seq. 3) has a reverse orientation and comprises a DVD heavy chain amino acid sequence of SEQ ID NO. 801 and a DVD light chain amino acid sequence of SEQ ID NO: 802.

In an embodiment, the binding protein capable of binding HGF (seq. 2) and VEGF (seq. 1) comprises a DVD heavy chain amino acid sequence selected from the group consisting of SEQ ID NO. 803 and SEQ ID NO. 805; and a DVD light chain amino acid sequence selected from the group consisting of SEQ ID NO. 804 and SEQ ID NO. 806. In an embodiment, the binding protein capable of binding HGF (seq. 2) and VEGF (seq. 1) comprises a DVD heavy chain amino acid sequence of SEQ ID NO. 803 and a DVD light chain amino acid sequence of SEQ ID NO: 804. In another embodiment, the binding protein capable of binding HGF (seq. 2) and VEGF (seq. 1) has a reverse orientation and comprises a DVD heavy chain amino acid sequence of SEQ ID NO. 805 and a DVD light chain amino acid sequence of SEQ ID NO: 806.

In a second embodiment, the binding protein capable of binding HGF (seq. 2) and VEGF (seq. 1) comprises a DVD heavy chain amino acid sequence selected from the group consisting of SEQ ID NO. 807 and SEQ ID NO. 809; and a DVD light chain amino acid sequence selected from the group consisting of SEQ ID NO. 808 and SEQ ID NO. 810. In an embodiment, the binding protein capable of binding HGF (seq. 2) and VEGF (seq. 1) comprises a DVD heavy chain amino acid sequence of SEQ ID NO. 807 and a DVD light chain amino acid sequence of SEQ ID NO: 808. In another embodiment, the binding protein capable of binding HGF (seq. 2) and VEGF (seq. 1) has a reverse orientation and comprises a DVD heavy chain amino acid sequence of SEQ ID NO. 809 and a DVD light chain amino acid sequence of SEQ ID NO: 810.

In a third embodiment, the binding protein capable of binding HGF (seq. 2) and VEGF (seq. 1) comprises a DVD heavy chain amino acid sequence selected from the group consisting of SEQ ID NO. 811 and SEQ ID NO. 813; and a DVD light chain amino acid sequence selected from the group consisting of SEQ ID NO. 812 and SEQ ID NO. 814. In an embodiment, the binding protein capable of binding HGF (seq. 2) and VEGF (seq. 1) comprises a DVD heavy chain amino acid sequence of SEQ ID NO. 811 and a DVD light chain amino acid sequence of SEQ ID NO: 812. In another embodiment, the binding protein capable of binding HGF (seq. 2) and VEGF (seq. 1) has a reverse orientation and comprises a DVD heavy chain amino acid sequence of SEQ ID NO. 813 and a DVD light chain amino acid sequence of SEQ ID NO: 814.

In a fourth embodiment, the binding protein capable of binding HGF (seq. 2) and VEGF (seq. 1) comprises a DVD heavy chain amino acid sequence selected from the group consisting of SEQ ID NO. 815 and SEQ ID NO. 817; and a DVD light chain amino acid sequence selected from the group consisting of SEQ ID NO. 816 and SEQ ID NO. 818. In an embodiment, the binding protein capable of binding HGF (seq. 2) and VEGF (seq. 1) comprises a DVD heavy chain amino acid sequence of SEQ ID NO. 815 and a DVD light chain amino acid sequence of SEQ ID NO: 816. In another embodiment, the binding protein capable of binding HGF (seq. 2) and VEGF (seq. 1) has a reverse orientation and comprises a DVD heavy chain amino acid sequence of SEQ ID NO. 817 and a DVD light chain amino acid sequence of SEQ ID NO: 818.

In an embodiment, the binding protein capable of binding HGF (seq. 2) and VEGF (seq. 2) comprises a DVD heavy chain amino acid sequence selected from the group consisting of SEQ ID NO. 819 and SEQ ID NO. 821; and a DVD light chain amino acid sequence selected from the group consisting of SEQ ID NO. 820 and SEQ ID NO. 822. In an embodiment, the binding protein capable of binding HGF (seq. 2) and VEGF (seq. 2) comprises a DVD heavy chain amino acid sequence of SEQ ID NO. 819 and a DVD light chain amino acid sequence of SEQ ID NO: 820. In another embodiment, the binding protein capable of binding HGF (seq. 2) and VEGF (seq. 2) has a reverse orientation and comprises a DVD heavy chain amino acid sequence of SEQ ID NO. 821 and a DVD light chain amino acid sequence of SEQ ID NO: 822.

In a second embodiment, the binding protein capable of binding HGF (seq. 2) and VEGF (seq. 2) comprises a DVD heavy chain amino acid sequence selected from the group consisting of SEQ ID NO. 823 and SEQ ID NO. 825; and a DVD light chain amino acid sequence selected from the group consisting of SEQ ID NO. 824 and SEQ ID NO. 826. In an embodiment, the binding protein capable of binding HGF (seq. 2) and VEGF (seq. 2) comprises a DVD heavy chain amino acid sequence of SEQ ID NO. 823 and a DVD light chain amino acid sequence of SEQ ID NO: 824. In another embodiment, the binding protein capable of binding HGF (seq. 2) and VEGF (seq. 2) has a reverse orientation and comprises a DVD heavy chain amino acid sequence of SEQ ID NO. 825 and a DVD light chain amino acid sequence of SEQ ID NO: 826.

In a third embodiment, the binding protein capable of binding HGF (seq. 2) and VEGF (seq. 2) comprises a DVD heavy chain amino acid sequence selected from the group consisting of SEQ ID NO. 827 and SEQ ID NO. 829; and a DVD light chain amino acid sequence selected from the group consisting of SEQ ID NO. 828 and SEQ ID NO. 830. In an embodiment, the binding protein capable of binding HGF (seq. 2) and VEGF (seq. 2) comprises a DVD heavy chain amino acid sequence of SEQ ID NO. 827 and a DVD light chain amino acid sequence of SEQ ID NO: 828. In another embodiment, the binding protein capable of binding HGF (seq. 2) and VEGF (seq. 2) has a reverse orientation and comprises a DVD heavy chain amino acid sequence of SEQ ID NO. 829 and a DVD light chain amino acid sequence of SEQ ID NO: 830.

In a fourth embodiment, the binding protein capable of binding HGF (seq. 2) and VEGF (seq. 2) comprises a DVD heavy chain amino acid sequence selected from the group consisting of SEQ ID NO. 831 and SEQ ID NO. 833; and a DVD light chain amino acid sequence selected from the group consisting of SEQ ID NO. 832 and SEQ ID NO. 834. In an embodiment, the binding protein capable of binding HGF (seq. 2) and VEGF (seq. 2) comprises a DVD heavy chain amino acid sequence of SEQ ID NO. 831 and a DVD light chain amino acid sequence of SEQ ID NO: 832. In another embodiment, the binding protein capable of binding HGF (seq. 2) and VEGF (seq. 2) has a reverse orientation and comprises a DVD heavy chain amino acid sequence of SEQ ID NO. 833 and a DVD light chain amino acid sequence of SEQ ID NO: 834.

In an embodiment, the binding protein capable of binding HGF (seq. 2) and VEGF (seq. 3) comprises a DVD heavy chain amino acid sequence selected from the group consisting of SEQ ID NO. 835 and SEQ ID NO. 837; and a DVD light chain amino acid sequence selected from the group consisting of SEQ ID NO. 836 and SEQ ID NO. 838. In an embodiment, the binding protein capable of binding HGF (seq. 2) and VEGF (seq. 3) comprises a DVD heavy chain amino acid sequence of SEQ ID NO. 835 and a DVD light chain amino acid sequence of SEQ ID NO: 836. In another embodiment, the binding protein capable of binding HGF (seq. 2) and VEGF (seq. 3) has a reverse orientation and comprises a DVD heavy chain amino acid sequence of SEQ ID NO. 837 and a DVD light chain amino acid sequence of SEQ ID NO: 838.

In a second embodiment, the binding protein capable of binding HGF (seq. 2) and VEGF (seq. 3) comprises a DVD heavy chain amino acid sequence selected from the group consisting of SEQ ID NO. 839 and SEQ ID NO. 841; and a DVD light chain amino acid sequence selected from the group consisting of SEQ ID NO. 840 and SEQ ID NO. 842. In an embodiment, the binding protein capable of binding HGF (seq. 2) and VEGF (seq. 3) comprises a DVD heavy chain amino acid sequence of SEQ ID NO. 839 and a DVD light chain amino acid sequence of SEQ ID NO: 840. In another embodiment, the binding protein capable of binding HGF (seq. 2) and VEGF (seq. 3) has a reverse orientation and comprises a DVD heavy chain amino acid sequence of SEQ ID NO. 841 and a DVD light chain amino acid sequence of SEQ ID NO: 842.

In a third embodiment, the binding protein capable of binding HGF (seq. 2) and VEGF (seq. 3) comprises a DVD heavy chain amino acid sequence selected from the group consisting of SEQ ID NO. 843 and SEQ ID NO. 845; and a DVD light chain amino acid sequence selected from the group consisting of SEQ ID NO. 844 and SEQ ID NO. 846. In an embodiment, the binding protein capable of binding HGF (seq. 2) and VEGF (seq. 3) comprises a DVD heavy chain amino acid sequence of SEQ ID NO. 843 and a DVD light chain amino acid sequence of SEQ ID NO: 844. In another embodiment, the binding protein capable of binding HGF (seq. 2) and VEGF (seq. 3) has a reverse orientation and comprises a DVD heavy chain amino acid sequence of SEQ ID NO. 845 and a DVD light chain amino acid sequence of SEQ ID NO: 846.

In a fourth embodiment, the binding protein capable of binding HGF (seq. 2) and VEGF (seq. 3) comprises a DVD heavy chain amino acid sequence selected from the group consisting of SEQ ID NO. 847 and SEQ ID NO. 849; and a DVD light chain amino acid sequence selected from the group consisting of SEQ ID NO. 848 and SEQ ID NO. 850. In an embodiment, the binding protein capable of binding HGF (seq. 2) and VEGF (seq. 3) comprises a DVD heavy chain amino acid sequence of SEQ ID NO. 847 and a DVD light chain amino acid sequence of SEQ ID NO: 848. In another embodiment, the binding protein capable of binding HGF (seq. 2) and VEGF (seq. 3) has a reverse orientation and comprises a DVD heavy chain amino acid sequence of SEQ ID NO. 849 and a DVD light chain amino acid sequence of SEQ ID NO: 850.

In an embodiment, the binding protein capable of binding HER-2 (seq. 1) and HER-2 (seq. 2) comprises a DVD heavy chain amino acid sequence selected from the group consisting of SEQ ID NO. 851 and SEQ ID NO. 853; and a DVD light chain amino acid sequence selected from the group consisting of SEQ ID NO. 852 and SEQ ID NO. 854. In an embodiment, the binding protein capable of binding HER-2 (seq. 1) and HER-2 (seq. 2) comprises a DVD heavy chain amino acid sequence of SEQ ID NO. 851 and a DVD light chain amino acid sequence of SEQ ID NO: 852. In another embodiment, the binding protein capable of binding HER-2 (seq. 1) and HER-2 (seq. 2) has a reverse orientation and comprises a DVD heavy chain amino acid sequence of SEQ ID NO. 853 and a DVD light chain amino acid sequence of SEQ ID NO: 854.

In a second embodiment, the binding protein capable of binding HER-2 (seq. 1) and HER-2 (seq. 2) comprises a DVD heavy chain amino acid sequence selected from the group consisting of SEQ ID NO. 855 and SEQ ID NO. 857; and a DVD light chain amino acid sequence selected from the group consisting of SEQ ID NO. 856 and SEQ ID NO. 858. In an embodiment, the binding protein capable of binding HER-2 (seq. 1) and HER-2 (seq. 2) comprises a DVD heavy chain amino acid sequence of SEQ ID NO. 855 and a DVD light chain amino acid sequence of SEQ ID NO: 856. In another embodiment, the binding protein capable of binding HER-2 (seq. 1) and HER-2 (seq. 2) has a reverse orientation and comprises a DVD heavy chain amino acid sequence of SEQ ID NO. 857 and a DVD light chain amino acid sequence of SEQ ID NO: 858.

In a third embodiment, the binding protein capable of binding HER-2 (seq. 1) and HER-2 (seq. 2) comprises a DVD heavy chain amino acid sequence selected from the group consisting of SEQ ID NO. 859 and SEQ ID NO. 861; and a DVD light chain amino acid sequence selected from the group consisting of SEQ ID NO. 860 and SEQ ID NO. 862. In an embodiment, the binding protein capable of binding HER-2 (seq. 1) and HER-2 (seq. 2) comprises a DVD heavy chain amino acid sequence of SEQ ID NO. 859 and a DVD light chain amino acid sequence of SEQ ID NO: 860. In another embodiment, the binding protein capable of binding HER-2 (seq. 1) and HER-2 (seq. 2) has a reverse orientation and comprises a DVD heavy chain amino acid sequence of SEQ ID NO. 861 and a DVD light chain amino acid sequence of SEQ ID NO: 862.

In a fourth embodiment, the binding protein capable of binding HER-2 (seq. 1) and HER-2 (seq. 2) comprises a DVD heavy chain amino acid sequence selected from the group consisting of SEQ ID NO. 863 and SEQ ID NO. 865; and a DVD light chain amino acid sequence selected from the group consisting of SEQ ID NO. 864 and SEQ ID NO. 866. In an embodiment, the binding protein capable of binding HER-2 (seq. 1) and HER-2 (seq. 2) comprises a DVD heavy chain amino acid sequence of SEQ ID NO. 863 and a DVD light chain amino acid sequence of SEQ ID NO: 864. In another embodiment, the binding protein capable of binding HER-2 (seq. 1) and HER-2 (seq. 2) has a reverse orientation and comprises a DVD heavy chain amino acid sequence of SEQ ID NO. 865 and a DVD light chain amino acid sequence of SEQ ID NO: 866.

In another embodiment the invention provides a binding protein comprising a polypeptide chain, wherein said polypeptide chain comprises VD1-(X1)n-VD2-C-(X2)n, wherein; VD1 is a first heavy chain variable domain obtained from a first parent antibody or antigen binding portion thereof; VD2 is a second heavy chain variable domain obtained from a second parent antibody or antigen binding portion thereof; C is a heavy chain constant domain; (X1)n is a linker with the proviso that it is not CH1, wherein said (X1)n is either present or absent; and (X2)n is an Fc region, wherein said (X2)n is either present or absent. In an embodiment, the Fc region is absent from the binding protein.

In another embodiment, the invention provides a binding protein comprising a polypeptide chain, wherein said polypeptide chain comprises VD1-(X1)n-VD2-C-(X2)n, wherein, VD1 is a first light chain variable domain obtained from a first parent antibody or antigen binding portion thereof; VD2 is a second light chain variable domain obtained from a second parent antibody or antigen binding portion thereof; C is a light chain constant domain; (X1)n is a linker with the proviso that it is not CH1, wherein said (X1)n is either present or absent; and (X2)n does not comprise an Fc region, wherein said (X2)n is either present or absent. In an embodiment, (X2)n is absent from the binding protein.

In another embodiment the binding protein of the invention comprises first and second polypeptide chains, wherein said first polypeptide chain comprises a first VD1-(X1)n-VD2-C-(X2)n, wherein VD1 is a first heavy chain variable domain obtained from a first parent antibody or antigen binding portion thereof; VD2 is a second heavy chain variable domain obtained from a second parent antibody or antigen binding portion thereof; C is a heavy chain constant domain; (X1)n is a linker with the proviso that it is not CH1, wherein said (X1)n is either present or absent; and (X2)n is an Fc region, wherein said (X2)n is either present or absent; and wherein said second polypeptide chain comprises a second VD1-(X1)n-VD2-C-(X2)n, wherein VD1 is a first light chain variable domain obtained from a first parent antibody or antigen binding portion thereof; VD2 is a second light chain variable domain obtained from a second parent antibody or antigen binding portion thereof; C is a light chain constant domain; (X1)n is a linker with the proviso that it is not CH1, wherein said (X1)n is either present or absent; and (X2)n does not comprise an Fc region, wherein said (X2)n is either present or absent. In another embodiment, the binding protein comprises two first polypeptide chains and two second polypeptide chains. In yet another embodiment, (X2)n is absent from the second polypeptide. In still another embodiment, the Fc region, if present in the first polypeptide is selected from the group consisting of native sequence Fc region and a variant sequence Fc region. In still another embodiment, the Fc region is selected from the group consisting of an Fc region from an IgG1, IgG2, IgG3, IgG4, IgA, IgM, IgE, and IgD.

In another embodiment the binding protein of the invention is a DVD-Ig capable of binding two antigens comprising four polypeptide chains, wherein, first and third polypeptide chains comprise VD1-(X1)n-VD2-C-(X2)n, wherein, VD1 is a first heavy chain variable domain obtained from a first parent antibody or antigen binding portion thereof; VD2 is a second heavy chain variable domain obtained from a second parent antibody or antigen binding portion thereof; C is a heavy chain constant domain; (X1)n is a linker with the proviso that it is not CH1, wherein said (X1)n is either present or absent; and (X2)n is an Fc region, wherein said (X2)n is either present or absent; and wherein second and fourth polypeptide chains comprise VD1-(X1)n-VD2-C-(X2)n, wherein VD1 is a first light chain variable domain obtained from a first parent antibody or antigen binding portion thereof; VD2 is a second light chain variable domain obtained from a second parent antibody or antigen binding portion thereof; C is a light chain constant domain; (X1)n is a linker with the proviso that it is not CH1, wherein said (X1)n is either present or absent; and (X2)n does not comprise an Fc region, wherein said (X2)n is either present or absent.

The invention provides a method of making a DVD-Ig binding protein by preselecting the parent antibodies. In an embodiment, the method of making a Dual Variable Domain Immunoglobulin capable of binding two antigens comprising the steps of a) obtaining a first parent antibody or antigen binding portion thereof, capable of binding a first antigen; b) obtaining a second parent antibody or antigen binding portion thereof, capable of binding a second antigen; c) constructing first and third polypeptide chains comprising VD1-(X1)n-VD2-C-(X2)n, wherein, VD1 is a first heavy chain variable domain obtained from said first parent antibody or antigen binding portion thereof; VD2 is a second heavy chain variable domain obtained from said second parent antibody or antigen binding portion thereof; C is a heavy chain constant domain; (X1)n is a linker with the proviso that it is not CH1, wherein said (X1)n is either present or absent; and (X2)n is an Fc region, wherein said (X2)n is either present or absent; d) constructing second and fourth polypeptide chains comprising VD1-(X1)n-VD2-C-(X2)n, wherein, VD1 is a first light chain variable domain obtained from said first parent antibody or antigen binding portion thereof; VD2 is a second light chain variable domain obtained from said second parent antibody or antigen binding portion thereof; C is a light chain constant domain; (X1)n is a linker with the proviso that it is not CH1, wherein said (X1)n is either present or absent; and (X2)n does not comprise an Fc region, wherein said (X2)n is either present or absent; e) expressing said first, second, third and fourth polypeptide chains; such that a Dual Variable Domain Immunoglobulin capable of binding said first and said second antigen is generated.

In still another embodiment, the invention provides a method of generating a Dual Variable Domain Immunoglobulin capable of binding two antigens with desired properties comprising the steps of a) obtaining a first parent antibody or antigen binding portion thereof, capable of binding a first antigen and possessing at least one desired property exhibited by the Dual Variable Domain Immunoglobulin; b) obtaining a second parent antibody or antigen binding portion thereof, capable of binding a second antigen and possessing at least one desired property exhibited by the Dual Variable Domain Immunoglobulin; c) constructing first and third polypeptide chains comprising VD1-(X1)n-VD2-C-(X2)n, wherein; VD1 is a first heavy chain variable domain obtained from said first parent antibody or antigen binding portion thereof; VD2 is a second heavy chain variable domain obtained from said second parent antibody or antigen binding portion thereof; C is a heavy chain constant domain; (X1)n is a linker with the proviso that it is not CH1, wherein said (X1)n is either present or absent; and (X2)n is an Fc region, wherein said (X2)n is either present or absent; d) constructing second and fourth polypeptide chains comprising VD1-(X1)n-VD2-C-(X2)n, wherein; VD1 is a first light chain variable domain obtained from said first parent antibody or antigen binding portion thereof; VD2 is a second light chain variable domain obtained from said second parent antibody or antigen binding portion thereof; C is a light chain constant domain; (X1)n is a linker with the proviso that it is not CH1, wherein said (X1)n is either present or absent; and (X2)n does not comprise an Fc region, wherein said (X2)n is either present or absent; e) expressing said first, second, third and fourth polypeptide chains; such that a Dual Variable Domain Immunoglobulin capable of binding said first and said second antigen with desired properties is generated.

In one embodiment, the VD1 of the first and second polypeptide chains disclosed herein are obtained from the same parent antibody or antigen binding portion thereof. In another embodiment, the VD1 of the first and second polypeptide chains disclosed herein are obtained from different parent antibodies or antigen binding portions thereof. In another embodiment, the VD2 of the first and second polypeptide chains disclosed herein are obtained from the same parent antibody or antigen binding portion thereof. In another embodiment, the VD2 of the first and second polypeptide chains disclosed herein are obtained from different parent antibodies or antigen binding portions thereof.

In one embodiment the first parent antibody or antigen binding portion thereof, and the second parent antibody or antigen binding portion thereof, are the same antibody. In another embodiment the first parent antibody or antigen binding portion thereof, and the second parent antibody or antigen binding portion thereof, are different antibodies.

In one embodiment the first parent antibody or antigen binding portion thereof, binds a first antigen and the second parent antibody or antigen binding portion thereof, binds a second antigen. In a particular embodiment, the first and second antigens are the same antigen. In another embodiment, the parent antibodies bind different epitopes on the same antigen. In another embodiment the first and second antigens are different antigens. In another embodiment, the first parent antibody or antigen binding portion thereof, binds the first antigen with a potency different from the potency with which the second parent antibody or antigen binding portion thereof, binds the second antigen. In yet another embodiment, the first parent antibody or antigen binding portion thereof, binds the first antigen with an affinity different from the affinity with which the second parent antibody or antigen binding portion thereof, binds the second antigen.

In another embodiment the first parent antibody or antigen binding portion thereof, and the second parent antibody or antigen binding portion thereof, are selected from the group consisting of, human antibody, CDR grafted antibody, and humanized antibody. In an embodiment, the antigen binding portions are selected from the group consisting of a Fab fragment, a F(ab')$_2$ fragment, a bivalent fragment comprising two Fab fragments linked by a disulfide bridge at the hinge region; a Fd fragment consisting of the VH and CH1 domains; a Fv fragment consisting of the VL and VH domains of a single arm of an antibody, a dAb fragment, an isolated complementarity determining region (CDR), a single chain antibody, and diabodies.

In another embodiment the binding protein of the invention possesses at least one desired property exhibited by the first parent antibody or antigen binding portion thereof, or the second parent antibody or antigen binding portion thereof. Alternatively, the first parent antibody or antigen binding portion thereof and the second parent antibody or antigen binding portion thereof possess at least one desired property exhibited by the Dual Variable Domain Immunoglobulin. In an embodiment, the desired property is selected from one or more antibody parameters. In another embodiment, the antibody parameters are selected from the group consisting of antigen specificity, affinity to antigen, potency, biological function, epitope recognition, stability, solubility, production efficiency, immunogenicity, pharmacokinetics, bioavailability, tissue cross reactivity, and orthologous antigen binding. In an embodiment the binding protein is multivalent. In another embodiment, the binding protein is multispecific. The multivalent and or multispecific binding proteins described herein have desirable properties particularly from a therapeutic standpoint. For instance, the multivalent and or multispecific binding protein may (1) be internalized (and/or catabolized) faster than a bivalent antibody by a cell expressing an antigen to which the antibodies bind; (2) be an agonist antibody; and/or (3) induce cell death and/or apoptosis of a cell expressing an antigen which the multivalent antibody is capable of binding to. The "parent antibody" which provides at least one antigen binding specificity of the multivalent and or multispecific binding proteins may be one which is internalized (and/or catabolized) by a cell expressing an antigen to which the antibody binds; and/or may be an agonist, cell death-inducing, and/or apoptosis-inducing antibody, and the multivalent and or multispecific binding protein as described herein may display improvement(s) in one or more of these properties. Moreover, the parent antibody may lack any one or more of these properties, but may be endowed with them when constructed as a multivalent binding protein as described herein.

In another embodiment the binding protein of the invention has an on rate constant (Kon) to one or more targets selected from the group consisting of: at least about $10^2 M^{-1} s^{-1}$; at least about $10^3 M^{-1} s^{-1}$; at least about $10^4 M^{-1} s^{-1}$; at least about $10^5 M^{-1} s^{-1}$; and at least about $10^6 M^{-1} s^{-1}$, as measured by surface plasmon resonance. In an embodiment, the binding protein of the invention has an on rate constant (Kon) to one or more targets between $10^2 M^{-1} s^{-1}$ and $10^3 M^{-1} s^{-1}$; between $10^3 M^{-1} s^{-1}$ and $10^4 M^{-1} s^{-1}$; between $10^4 M^{-1} s^{-1}$ and $10^5 M^{-1} s^{-1}$; or between $10^5 M^{-1} s^{-1}$ and $10^6 M^{-1} s^{-1}$, as measured by surface plasmon resonance.

In another embodiment the binding protein has an off rate constant (Koff) for one or more targets selected from the group consisting of: at most about $10^{-3}$ s$^{-1}$; at most about $10^{-4}$ s$^{-1}$; at most about $10^{-5}$ s$^{-1}$; and at most about $10^{-6}$ s$^{-1}$, as measured by surface plasmon resonance. In an embodiment, the binding protein of the invention has an off rate constant (Koff) to one or more targets of $10^{-3}$ s$^{-1}$ to $10^{-4}$ s$^{-1}$; of $10^{-4}$ s$^{-1}$ to $10^{-5}$ s$^{-1}$; or of $10^{-5}$ s$^{-1}$ to $10^{-6}$ s$^{-1}$, as measured by surface plasmon resonance.

In another embodiment the binding protein has a dissociation constant (K$_D$) to one or more targets selected from the group consisting of: at most about $10^{-7}$ M; at most about $10^{-8}$ M; at most about $10^{-9}$ M; at most about $10^{-10}$ M; at most about $10^{-11}$ M; at most about $10^{-12}$ M; and at most $10^{-13}$ M. In an embodiment, the binding protein of the invention has a dissociation constant M; (K$_D$) to its targets of $10^{-7}$ M to $10^{-8}$ M; of $10^{-8}$ M to $10^{-9}$ M; of $10^{-9}$ M to $10^{-10}$ M; of $10^{-10}$ to $10^{-11}$ M; of $10^{-11}$ M to $10^{-12}$ M; or of $10^{-12}$ M to $10^{-13}$ M.

In another embodiment, the binding protein described herein is a conjugate further comprising an agent selected from the group consisting of an immunoadhesion molecule, an imaging agent, a therapeutic agent, and a cytotoxic agent. In an embodiment, the imaging agent is selected from the group consisting of a radiolabel, an enzyme, a fluorescent label, a luminescent label, a bioluminescent label, a magnetic label, and biotin. In another embodiment, the imaging agent is a radiolabel selected from the group consisting of: $^3$H, $^{14}$C, $^{35}$S, $^{90}$Y, $^{99}$Tc, $^{111}$In, $^{125}$I, $^{131}$I, $^{177}$Lu, $^{166}$Ho, and $^{153}$Sm. In yet another embodiment, the therapeutic or cytotoxic agent is selected from the group consisting of an anti-metabolite, an alkylating agent, an antibiotic, a growth factor, a cytokine, an anti-angiogenic agent, an anti-mitotic agent, an anthracycline, toxin, and an apoptotic agent.

In another embodiment, the binding protein described herein is a crystallized binding protein and exists as a crystal. In an embodiment, the crystal is a carrier-free pharmaceutical controlled release crystal. In yet another embodiment, the crystallized binding protein has a greater half life in vivo than the soluble counterpart of said binding protein. In still another embodiment, the crystallized binding protein retains biological activity.

In another embodiment, the binding protein described herein is glycosylated. For example, the glycosylation is a human glycosylation pattern.

One aspect of the invention pertains to an isolated nucleic acid encoding any one of the binding proteins disclosed herein. A further embodiment provides a vector comprising the isolated nucleic acid disclosed herein wherein said vector is selected from the group consisting of pcDNA; pTT (Durocher et al., *Nucleic Acids Research* 2002, Vol 30, No. 2); pTT3 (pTT with additional multiple cloning site; pEFBOS (Mizushima, S, and Nagata, S., (1990) *Nucleic acids Research* Vol 18, No. 17); pBV; pJV; pcDNA3.1 TOPO, pEF6 TOPO and pBJ. In an embodiment, the vector is a vector disclosed in U.S. Patent Application Ser. No. 61/021,282.

In another aspect a host cell is transformed with the vector disclosed herein. In an embodiment, the host cell is a prokaryotic cell. In another embodiment, the host cell is *E. Coli*. In a related embodiment the host cell is a eukaryotic cell. In another embodiment, the eukaryotic cell is selected from the group consisting of protist cell, animal cell, plant cell and fungal cell. In yet another embodiment, the host cell is a mammalian cell including, but not limited to, CHO, COS; NS0, SP2, PER.C6 or a fungal cell such as *Saccharomyces cerevisiae*; or an insect cell such as Sf9.

In an embodiment, two or more DVD-Igs, e.g., with different specificities, are produced in a single recombinant host cell. For example, the expression of a mixture of antibodies has been called Oligoclonics™, (Merus B. V., The Netherlands) U.S. Pat. Nos. 7,262,028; 7,429,486.

Another aspect of the invention provides a method of producing a binding protein disclosed herein comprising culturing any one of the host cells also disclosed herein in a culture medium under conditions sufficient to produce the binding protein. In an embodiment, 50%-75% of the binding protein produced by this method is a dual specific tetravalent binding protein. In a particular embodiment, 75%-90% of the binding protein produced by this method is a dual specific tetravalent binding protein. In a particular embodiment, 90%-95% of the binding protein produced is a dual specific tetravalent binding protein.

One embodiment provides a composition for the release of a binding protein wherein the composition comprises a formulation that in turn comprises a crystallized binding protein, as disclosed herein, and an ingredient, and at least one polymeric carrier. For example, the polymeric carrier is a polymer selected from one or more of the group consisting of: poly (acrylic acid), poly (cyanoacrylates), poly (amino acids), poly (anhydrides), poly (depsipeptide), poly (esters), poly (lactic acid), poly (lactic-co-glycolic acid) or PLGA, poly (b-hydroxybutryate), poly (caprolactone), poly (dioxanone); poly (ethylene glycol), poly ((hydroxypropyl) methacrylamide, poly [(organo)phosphazene], poly (ortho esters), poly (vinyl alcohol), poly (vinylpyrrolidone), maleic anhydride-alkyl vinyl ether copolymers, pluronic polyols, albumin, alginate, cellulose and cellulose derivatives, collagen, fibrin, gelatin, hyaluronic acid, oligosaccharides, glycaminoglycans, sulfated polysaccharides, blends and copolymers thereof. For example, the ingredient is selected from the group consisting of albumin, sucrose, trehalose, lactitol, gelatin, hydroxypropyl-β-cyclodextrin, methoxypolyethylene glycol and polyethylene glycol. Another embodiment provides a method for treating a mammal comprising the step of administering to the mammal an effective amount of the composition disclosed herein.

The invention also provides a pharmaceutical composition comprising a binding protein, as disclosed herein and a pharmaceutically acceptable carrier. In a further embodiment the pharmaceutical composition comprises at least one additional therapeutic agent for treating a disorder. For example, the additional agent is selected from the group consisting of: a therapeutic agent, an imaging agent, a cytotoxic agent, an angiogenesis inhibitor (including but not limited to an anti-VEGF antibody or a VEGF-trap), a kinase inhibitor (including but not limited to a KDR and a TIE-2 inhibitor), a co-stimulation molecule blocker (including but not limited to anti-B7.1, anti-B7.2, CTLA4-Ig, anti-CD20), an adhesion molecule blocker (including but not limited to an anti-LFA-1 antibody, an anti-E/L selectin antibody, a small molecule inhibitor), an anti-cytokine antibody or functional fragment thereof (including but not limited to an anti-IL-18, an anti-TNF, and an anti-IL-6/cytokine receptor antibody), methotrexate, cyclosporin, rapamycin, FK506, a detectable label or reporter, a TNF antagonist, an antirheumatic, a muscle relaxant, a narcotic, a non-steroid anti-inflammatory drug (NSAID), an analgesic, an anesthetic, a sedative, a local anesthetic, a neuromuscular blocker, an antimicrobial, an antipsoriatic, a corticosteriod, an anabolic steroid, an erythropoietin, an immunization, an immunoglobulin, an immunosuppressive, a growth hormone, a hormone replacement drug, a radiopharmaceutical, an antidepressant, an antipsychotic, a stimulant, an asthma medication, a beta agonist, an inhaled steroid, an epinephrine or analog, a cytokine, and a cytokine antagonist.

In another aspect, the invention provides a method for treating a human subject suffering from a disorder in which the target, or targets, capable of being bound by the binding protein disclosed herein is detrimental, comprising administering to the human subject a binding protein disclosed herein such that the activity of the target, or targets in the human subject is inhibited and one of more symptoms is alleviated or treatment is achieved. For example, the disorder is selected from the group comprising arthritis, osteoarthritis, juvenile chronic arthritis, septic arthritis, Lyme arthritis, psoriatic arthritis, reactive arthritis, spondyloarthropathy, systemic lupus erythematosus, Crohn's disease, ulcerative colitis, inflammatory bowel disease, insulin dependent diabetes mellitus, thyroiditis, asthma, allergic diseases, psoriasis, dermatitis scleroderma, graft versus host disease, organ transplant rejection, acute or chronic immune disease associated with organ transplantation, sarcoidosis, atherosclerosis, disseminated intravascular coagulation, Kawasaki's disease, Grave's disease, nephrotic syndrome, chronic fatigue syndrome, Wegener's granulomatosis, Henoch-Schoenlein purpurea, microscopic vasculitis of the kidneys, chronic active hepatitis, uveitis, septic shock, toxic shock syndrome, sepsis syndrome, cachexia, infectious diseases, parasitic diseases, acquired immunodeficiency syndrome, acute transverse myelitis, Huntington's chorea, Parkinson's disease, Alzheimer's disease, stroke, primary biliary cirrhosis, hemolytic anemia, malignancies, heart failure, myocardial infarction, Addison's disease, sporadic polyglandular deficiency type I and polyglandular deficiency type II, Schmidt's syndrome, adult (acute) respiratory distress syndrome, alopecia, alopecia greata, seronegative arthopathy, arthropathy, Reiter's disease, psoriatic arthropathy, ulcerative colitic arthropathy, enteropathic synovitis, *chlamydia, yersinia* and *salmonella* associated arthropathy, spondyloarthopathy, atheromatous disease/arteriosclerosis, atopic allergy, autoimmune bullous disease, pemphigus vulgaris, pemphigus foliaceus, pemphigoid, linear IgA disease, autoimmune haemolytic anaemia, Coombs positive haemolytic anaemia, acquired pernicious anaemia, juvenile pernicious anaemia, myalgic encephalitis/Royal Free Disease, chronic mucocutaneous candidiasis, giant cell arteritis, primary sclerosing hepatitis, cryptogenic autoimmune hepatitis, Acquired Immunodeficiency Disease Syndrome, Acquired Immunodeficiency Related Diseases, Hepatitis B, Hepatitis C, common varied immunodeficiency (common variable hypogammaglobulinaemia), dilated cardiomyopathy, female infertility, ovarian failure, premature ovarian failure, fibrotic lung disease, cryptogenic fibrosing alveolitis, post-inflammatory interstitial lung disease, interstitial pneumonitis, connective tissue disease associated interstitial lung disease, mixed connective tissue disease associated lung disease, systemic sclerosis associated interstitial lung disease, rheumatoid arthritis associated interstitial lung disease, systemic lupus erythematosus associated lung disease, dermatomyositis/polymyositis associated lung disease, Sjögren's disease associated lung disease, ankylosing spondylitis associated lung disease, vasculitic diffuse lung disease, haemosiderosis associated lung disease, drug-induced interstitial lung disease, fibrosis, radiation fibrosis, bronchiolitis obliterans, chronic eosinophilic pneumonia, lymphocytic infiltrative lung disease, postinfectious interstitial lung disease, gouty arthritis, autoimmune hepatitis, type-1 autoimmune hepatitis (classical autoimmune or lupoid hepatitis), type-2 autoimmune hepatitis (anti-LKM antibody hepatitis), autoimmune mediated hypoglycaemia, type B insulin resistance with acanthosis nigricans, hypoparathyroidism, acute immune disease associated with organ transplantation, chronic immune disease associated with organ transplantation, osteoarthrosis, primary sclerosing cholangitis, psoriasis type 1, psoriasis type 2, idiopathic leucopaenia, autoimmune neutropaenia, renal disease NOS, glomerulonephritides, microscopic vasulitis of the kidneys, lyme disease, discoid lupus erythematosus, male infertility idiopathic or NOS, sperm autoimmunity, multiple sclerosis (all subtypes), sympathetic ophthalmia, pulmonary hypertension secondary to connective tissue disease, Goodpasture's syndrome, pulmonary manifestation of polyarteritis nodosa, acute rheumatic fever, rheumatoid spondylitis, Still's disease, systemic sclerosis, Sjögren's syndrome, Takayasu's disease/arteritis, autoimmune thrombocytopaenia, idiopathic thrombocytopaenia, autoimmune thyroid disease, hyperthyroidism, goitrous autoimmune hypothyroidism (Hashimoto's disease), atrophic autoimmune hypothyroidism, primary myxoedema, phacogenic uveitis, primary vasculitis, vitiligo acute liver disease, chronic liver diseases, alcoholic cirrhosis, alcohol-induced liver injury, choleosatatis, idiosyncratic liver disease, Drug-Induced hepatitis, Non-alcoholic Steatohepatitis, allergy and asthma, group B streptococci (GBS) infection, mental disorders (e.g., depression and schizophrenia), Th2 Type and Th1 Type mediated diseases, acute and chronic pain (different forms of pain), and cancers such as lung, breast, stomach, bladder, colon, pancreas, ovarian, prostate and rectal cancer and hematopoietic malignancies (leukemia and lymphoma), Abetalipoprotemia, Acrocyanosis, acute and chronic parasitic or infectious processes, acute leukemia, acute lymphoblastic leukemia (ALL), acute myeloid leukemia (AML), acute or chronic bacterial infection, acute pancreatitis, acute renal failure, adenocarcinomas, aerial ectopic beats, AIDS dementia complex, alcohol-induced hepatitis, allergic conjunctivitis, allergic contact dermatitis, allergic rhinitis, allograft rejection, alpha-1-antitrypsin deficiency, amyotrophic lateral sclerosis, anemia, angina pectoris, anterior horn cell degeneration, anti cd3 therapy, antiphospholipid syndrome, anti-receptor hypersensitivity reactions, aortic and peripheral aneuryisms, aortic dissection, arterial hypertension, arteriosclerosis, arteriovenous fistula, ataxia, atrial fibrillation (sustained or paroxysmal), atrial flutter, atrioventricular block, B cell lymphoma, bone graft rejection, bone marrow transplant (BMT) rejection, bundle branch block, Burkitt's lymphoma, Burns, cardiac arrythmias, cardiac stun syndrome, cardiac tumors, cardiomyopathy, cardiopulmonary bypass inflammation response, cartilage transplant rejection, cerebellar cortical degenerations, cerebellar disorders, chaotic or multifocal atrial tachycardia, chemotherapy associated disorders, chronic myelocytic leukemia (CML), chronic alcoholism, chronic inflammatory pathologies, chronic lymphocytic leukemia (CLL), chronic obstructive pulmonary disease (COPD), chronic salicylate intoxication, colorectal carcinoma, congestive heart failure, conjunctivitis, contact dermatitis, corpulmonale, coronary artery disease, Creutzfeldt-Jakob disease, culture negative sepsis, cystic fibrosis, cytokine therapy associated disorders, Dementia pugilistica, demyelinating diseases, dengue hemorrhagic fever, dermatitis, dermatologic conditions, diabetes, diabetes mellitus, diabetic ateriosclerotic disease, Diffuse Lewy body disease, dilated congestive cardiomyopathy, disorders of the basal ganglia, Down's Syndrome in middle age, drug-induced movement disorders induced by drugs which block CNS dopamine receptors, drug sensitivity, eczema, encephalomyelitis, endocarditis, endocrinopathy, epiglottitis, epstein-barr virus infection, erythromelalgia, extrapyramidal and cerebellar disorders, familial hematophagocytic lymphohistiocytosis, fetal thymus implant rejection, Friedreich's ataxia, functional peripheral arterial disorders, fungal sepsis, gas gangrene, gastric ulcer, glomerular nephritis, graft rejection of any organ or tissue, gram negative sepsis, gram positive sepsis, granulomas due to intracellular organisms, hairy cell leukemia, Hallerrorden-Spatz disease, hashimoto's thyroiditis, hay fever, heart transplant rejection, hemachromatosis, hemodialysis, hemolytic uremic syndrome/thrombolytic thrombocytopenic purpura, hemorrhage, hepatitis (A), His bundle arrythmias, HIV infection/HIV neuropathy, Hodgkin's disease, hyperkinetic movement disorders, hypersensitity reactions, hypersensitivity pneumonitis, hypertension, hypokinetic movement disorders, hypothalamic-pituitary-adrenal axis evaluation, idiopathic Addison's disease, idiopathic pulmonary fibrosis, antibody mediated cytotoxicity, Asthenia, infantile spinal muscular atrophy, inflammation of the aorta, influenza a, ionizing radiation exposure, iridocyclitis/uveitis/optic neuritis, ischemia-reperfusion injury, ischemic stroke, juvenile rheumatoid arthritis, juvenile spinal muscular atrophy, Kaposi's sarcoma, kidney transplant rejection, legionella, leishmaniasis, leprosy, lesions of the corticospinal system, lipedema, liver transplant rejection, lymphederma, malaria, malignant Lymphoma, malignant histiocytosis, malignant melanoma, meningitis, meningococcemia, metabolic/idiopathic diseases, migraine headache, mitochondrial multi.system disorder, mixed connective tissue disease, monoclonal gammopathy, multiple myeloma, multiple systems degenerations (Mencel Dejerine-Thomas Shi-Drager and Machado-Joseph), myasthenia gravis, *mycobacterium avium* intracellulare, *mycobacterium tuberculosis*, myelodyplastic syndrome, myocardial infarction, myocardial ischemic disorders, nasopharyngeal carcinoma, neonatal chronic lung disease, nephritis, nephrosis, neurodegenerative diseases, neurogenic I muscular atrophies, neutropenic fever, non-hodgkins lymphoma, occlusion of the abdominal aorta and its branches, occlusive arterial disorders, okt3 therapy, orchitis/epidydimitis, orchitis/vasectomy reversal procedures, organomegaly, osteoporosis, pancreas transplant rejection, pancreatic carcinoma, paraneoplastic syndrome/hypercalcemia of malignancy, parathyroid transplant rejection, pelvic inflammatory disease, perennial rhinitis, pericardial disease, peripheral atherlosclerotic disease, peripheral vascular disorders, peritonitis, pernicious anemia, *pneumocystis carinii* pneumonia, pneumonia, POEMS syndrome (polyneuropathy, organomegaly, endocrinopathy, monoclonal gammopathy, and skin changes syndrome), post perfusion syndrome, post pump syndrome, post-MI cardiotomy syndrome, preeclampsia, Progressive supranucleo Palsy, primary pulmonary hypertension, radiation therapy, Raynaud's phenomenon and disease, Raynoud's disease, Refsum's disease, regular narrow QRS tachycardia, renovascular hypertension, reperfusion injury, restrictive cardiomyopathy, sarcomas, scleroderma, senile chorea, Senile Dementia of Lewy body type, seronegative arthropathies, shock, sickle cell anemia, skin allograft rejection, skin changes syndrome, small bowel transplant rejection, solid tumors, specific arrythmias, spinal ataxia, spinocerebellar degenerations, streptococcal myositis, structural lesions of the cerebellum, Subacute sclerosing panencephalitis, Syncope, syphilis of the cardiovascular system, systemic anaphalaxis, systemic inflammatory response syndrome, systemic onset juvenile rheumatoid arthritis, T-cell or FAB ALL, Telangiectasia, thromboangitis obliterans, thrombocytopenia, toxicity, transplants, trauma/hemorrhage, type III hypersensitivity reactions, type IV hypersensitivity, unstable angina, uremia, urosepsis, urticaria, valvular heart diseases, varicose veins, vasculitis, venous diseases, venous thrombosis, ventricular fibrillation, viral and fungal infections, vital encephalitis/aseptic meningitis, vital-associated hemaphagocytic syndrome, Wernicke-Korsakoff syndrome, Wilson's disease, xenograft rejection of any organ or tissue, acute coronary syndromes, acute idiopathic polyneuritis, acute inflammatory demyelinating polyradiculoneuropathy, acute ischemia, adult Still's disease, alopecia greata, anaphylaxis, antiphospholipid antibody syndrome, aplastic anemia, arteriosclerosis, atopic eczema, atopic dermatitis, autoimmune dermatitis, autoimmune disorder associated with *streptococcus* infection, autoimmune enteropathy, autoimmune hearing loss, autoimmune lymphoproliferative syndrome (ALPS), autoimmune myocarditis, autoimmune premature ovarian failure, blepharitis, bronchiectasis, bullous pemphigoid, cardiovascular disease, catastrophic antiphospholipid syndrome, celiac disease, cervical spondylosis, chronic ischemia, cicatricial pemphigoid, clinically isolated syndrome (cis) with risk for multiple sclerosis, conjunctivitis, childhood onset psychiatric disorder, chronic obstructive pulmonary disease (COPD), dacryocystitis, dermatomyositis, diabetic retinopathy, diabetes mellitus, disk herniation, disk prolaps, drug induced immune hemolytic anemia, endocarditis, endometriosis, endophthalmitis, episcleritis, erythema multiforme, erythema multiforme major, gestational pemphigoid, Guillain-Barré syndrome (GBS), hay fever, Hughes syndrome, idiopathic Parkinson's disease, idiopathic interstitial pneumonia, IgE-mediated allergy, immune hemolytic anemia, inclusion body myositis, infectious ocular inflammatory disease, inflammatory demyelinating disease, inflammatory heart disease, inflammatory kidney disease, IPF/UIP, iritis, keratitis, keratojuntivitis sicca, Kussmaul disease or Kussmaul-Meier disease, Landry's paralysis, Langerhan's cell histiocytosis, livedo reticularis, macular degeneration, microscopic polyangiitis, morbus bechterev, motor neuron disorders, mucous membrane pemphigoid, multiple organ failure, myasthenia gravis, myelodysplastic syndrome, myocarditis, nerve root disorders, neuropathy, non-A non-B hepatitis, optic neuritis, osteolysis, ovarian cancer, pauciarticular JRA, peripheral artery occlusive disease (PAOD), peripheral vascular disease (PVD), peripheral artery, disease (PAD), phlebitis, polyarteritis nodosa (or periarteritis nodosa), polychondritis, polymyalgia rheumatica, poliosis, polyarticular JRA, polyendocrine deficiency syndrome, polymyositis, polymyalgia rheumatica (PMR), post-pump syndrome, primary Parkinsonism, prostate and rectal cancer and hematopoietic malignancies (leukemia and lymphoma), prostatitis, pure red cell aplasia, primary adrenal insufficiency, recurrent neuromyelitis optica, restenosis, rheumatic heart disease, sapho (synovitis, acne, pustulosis, hyperostosis, and osteitis), scleroderma, secondary amyloidosis, shock lung, scleritis, sciatica, secondary adrenal insufficiency, silicone associated connective tissue disease, sneddon-wilkinson dermatosis, spondilitis ankylosans, Stevens-Johnson syndrome (SJS), systemic inflammatory response syndrome, temporal arteritis, toxoplasmic retinitis, toxic epidermal necrolysis, transverse myelitis, TRAPS (tumor necrosis factor receptor, type 1 allergic reaction, type II diabetes, urticaria, usual interstitial pneumonia (UIP), vasculitis, vernal conjunctivitis, viral retinitis, Vogt-Koyanagi-Harada syndrome (VKH syndrome), wet macular degeneration, wound healing, *yersinia* and *salmonella* associated arthropathy.

In an embodiment, diseases that can be treated or diagnosed with the compositions and methods of the invention include, but are not limited to, primary and metastatic cancers, including carcinomas of breast, colon, rectum, lung, oropharynx, hypopharynx, esophagus, stomach, pancreas, liver, gallbladder and bile ducts, small intestine, urinary tract (including kidney, bladder and urothelium), female genital tract (including cervix, uterus, and ovaries as well as choriocarcinoma and gestational trophoblastic disease), male genital tract (including prostate, seminal vesicles, testes and germ cell tumors), endocrine glands (including the thyroid, adrenal, and pituitary glands), and skin, as well as hemangiomas, melanomas, sarcomas (including those arising from bone and soft tissues as well as Kaposi's sarcoma), tumors of the brain, nerves, eyes, and meninges (including astrocytomas, gliomas, glioblastomas, retinoblastomas, neuromas, neuroblastomas, Schwannomas, and meningiomas), solid tumors arising from hematopoietic malignancies such as leukemias, and lymphomas (both Hodgkin's and non-Hodgkin's lymphomas).

In an embodiment, the antibodies of the invention or antigen-binding portions thereof, are used to treat cancer or in the prevention of metastases from the tumors described herein either when used alone or in combination with radiotherapy and/or other chemotherapeutic agents.

In another aspect the invention provides a method of treating a patient suffering from a disorder comprising the step of administering any one of the binding proteins disclosed herein before, concurrent, or after the administration of a second agent, as discussed herein. In a particular embodiment the second agent is selected from the group consisting of budenoside, epidermal growth factor, corticosteroids, cyclosporin, sulfasalazine, aminosalicylates, 6-mercaptopurine, azathioprine, metronidazole, lipoxygenase inhibitors, mesalamine, olsalazine, balsalazide, antioxidants, thromboxane inhibitors, IL-1 receptor antagonists, anti-IL-1β mAbs, anti-IL-6 or IL-6 receptor mAbs, growth factors, elastase inhibitors, pyridinyl-imidazole compounds, antibodies or agonists of TNF, LT, IL-1, IL-2, IL-6, IL-7, IL-8, IL-12, IL-13, IL-15, IL-16, IL-18, IL-23, EMAP-II, GM-CSF, FGF, and PDGF, antibodies of CD2, CD3, CD4, CD8, CD-19, CD25, CD28, CD30, CD40, CD45, CD69, CD90 or their ligands, methotrexate, cyclosporin, FK506, rapamycin, mycophenolate mofetil, leflunomide, NSAIDs, ibuprofen, corticosteroids, prednisolone, phosphodiesterase inhibitors, adenosine agonists, antithrombotic agents, complement inhibitors, adrenergic agents, IRAK, NIK, IKK, p38, MAP kinase inhibitors, IL-1β converting enzyme inhibitors, TNFα converting enzyme inhibitors, T-cell signalling inhibitors, metalloproteinase inhibitors, sulfasalazine, azathioprine, 6-mercaptopurines, angiotensin converting enzyme inhibitors, soluble cytokine receptors, soluble p55 TNF receptor, soluble p75 TNF receptor, sIL-1RI, sIL-1RII, sIL-6R, antiinflammatory cytokines, IL-4, IL-10, IL-11, IL-13 and TGFβ.

In a particular embodiment the pharmaceutical compositions disclosed herein are administered to the patient by at least one mode selected from parenteral, subcutaneous, intramuscular, intravenous, intrarticular, intrabronchial, intraabdominal, intracapsular, intracartilaginous, intracavitary, intracelial, intracerebellar, intracerebroventricular, intracolic, intracervical, intragastric, intrahepatic, intramyocardial, intraosteal, intrapelvic, intrapericardiac, intraperitoneal, intrapleural, intraprostatic, intrapulmonary, intrarectal, intrarenal, intraretinal, intraspinal, intrasynovial, intrathoracic, intrauterine, intravesical, bolus, vaginal, rectal, buccal, sublingual, intranasal, and transdermal.

One aspect of the invention provides at least one anti-idiotype antibody to at least one binding protein of the present invention. The anti-idiotype antibody includes any protein or peptide containing molecule that comprises at least a portion of an immunoglobulin molecule such as, but not limited to, at least one complementarily determining region (CDR) of a heavy or light chain or a ligand binding portion thereof, a heavy chain or light chain variable region, a heavy chain or light chain constant region, a framework region, or any portion thereof, that can be incorporated into a binding protein of the present invention.

DETAILED DESCRIPTION OF THE INVENTION

Figure 1:
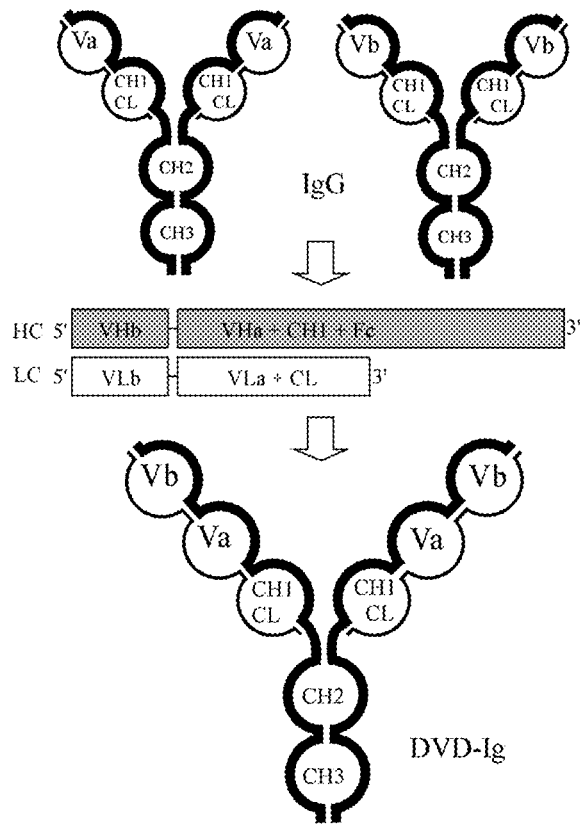
FIG. 1A is a schematic representation of Dual Variable Domain (DVD)-Ig constructs and shows the strategy for generation of a DVD-Ig from two parent antibodies.
FIG. 1B, is a schematic representation of constructs DVD1-Ig, DVD2-Ig, and two chimeric mono-specific antibodies from hybridoma clones 2D13.E3 (anti-IL-1α) and 13F5.G5 (anti-IL-1β).
Figure 1:
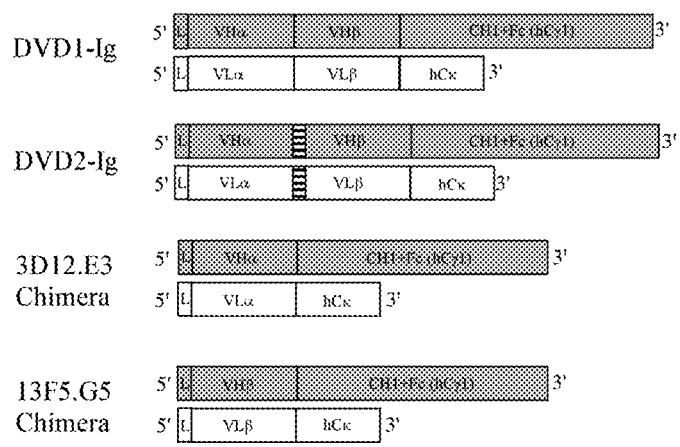

This invention pertains to multivalent and/or multispecific binding proteins capable of binding two or more antigens. Specifically, the invention relates to dual variable domain immunoglobulins (DVD-Ig), and pharmaceutical compositions thereof, as well as nucleic acids, recombinant expression vectors and host cells for making such DVD-Igs. Methods of using the DVD-Igs of the invention to detect specific antigens, either in vitro or in vivo are also encompassed by the invention.

Unless otherwise defined herein, scientific and technical terms used in connection with the present invention shall have the meanings that are commonly understood by those of ordinary skill in the art. The meaning and scope of the terms should be clear, however, in the event of any latent ambiguity, definitions provided herein take precedent over any dictionary or extrinsic definition. Further, unless otherwise required by context, singular terms shall include pluralities and plural terms shall include the singular. In this application, the use of "or" means "and/or" unless stated otherwise. Furthermore, the use of the term "including", as well as other forms, such as "includes" and "included", is not limiting. Also, terms such as "element" or "component" encompass both elements and components comprising one unit and elements and components that comprise more than one subunit unless specifically stated otherwise.

Generally, nomenclatures used in connection with, and techniques of, cell and tissue culture, molecular biology, immunology, microbiology, genetics and protein and nucleic acid chemistry and hybridization described herein are those well known and commonly used in the art. The methods and techniques of the present invention are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well known and commonly used in the art. Standard techniques are used for chemical syntheses, chemical analyses, pharmaceutical preparation, formulation, and delivery, and treatment of patients.

That the present invention may be more readily understood, select terms are defined below.

The term "polypeptide" as used herein, refers to any polymeric chain of amino acids. The terms "peptide" and "protein" are used interchangeably with the term polypeptide and also refer to a polymeric chain of amino acids. The term "polypeptide" encompasses native or artificial proteins, protein fragments and polypeptide analogs of a protein sequence. A polypeptide may be monomeric or polymeric. Use of "polypeptide" herein is intended to encompass polypeptide and fragments and variants (including fragments of variants) thereof, unless otherwise contradicted by context. For an antigenic polypeptide, a fragment of polypeptide optionally contains at least one contiguous or nonlinear epitope of polypeptide. The precise boundaries of the at least one epitope fragment can be confirmed using ordinary skill in the art. The fragment comprises at least about 5 contiguous amino acids, such as at least about 10 contiguous amino acids, at least about 15 contiguous amino acids, or at least about 20 contiguous amino acids. A variant of polypeptide is as described herein.

The term "isolated protein" or "isolated polypeptide" is a protein or polypeptide that by virtue of its origin or source of derivation is not associated with naturally associated components that accompany it in its native state; is substantially free of other proteins from the same species; is expressed by a cell from a different species; or does not occur in nature. Thus, a polypeptide that is chemically synthesized or synthesized in a cellular system different from the cell from which it naturally originates will be "isolated" from its naturally associated components. A protein may also be rendered substantially free of naturally associated components by isolation, using protein purification techniques well known in the art.

The term "recovering" as used herein, refers to the process of rendering a chemical species such as a polypeptide substantially free of naturally associated components by isolation, e.g., using protein purification techniques well known in the art.

"Biological activity" as used herein, refers to any one or more inherent biological properties of a molecule (whether present naturally as found in vivo, or provided or enabled by recombinant means). Biological properties include but are not limited to binding receptor; induction of cell proliferation, inhibiting cell growth, inductions of other cytokines, induction of apoptosis, and enzymatic activity. Biological activity also includes activity of an Ig molecule.

The terms "specific binding" or "specifically binding", as used herein, in reference to the interaction of an antibody, a protein, or a peptide with a second chemical species, mean that the interaction is dependent upon the presence of a particular structure (e.g., an antigenic determinant or epitope) on the chemical species; for example, an antibody recognizes and binds to a specific protein structure rather than to proteins generally. If an antibody is specific for epitope "A", the presence of a molecule containing epitope A (or free, unlabeled A), in a reaction containing labeled "A" and the antibody, will reduce the amount of labeled A bound to the antibody.

The term "antibody", as used herein, broadly refers to any immunoglobulin (Ig) molecule comprised of four polypeptide chains, two heavy (H) chains and two light (L) chains, or any functional fragment, mutant, variant, or derivation thereof, which retains the essential epitope binding features of an Ig molecule. Such mutant, variant, or derivative antibody formats are known in the art. Nonlimiting embodiments of which are discussed below.

In a full-length antibody, each heavy chain is comprised of a heavy chain variable region (abbreviated herein as HCVR or VH) and a heavy chain constant region. The heavy chain constant region is comprised of three domains, CH1, CH2 and CH3. Each light chain is comprised of a light chain variable region (abbreviated herein as LCVR or VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. Immunoglobulin molecules can be of any type (e.g., IgG, IgE, IgM, IgD, IgA and IgY), class (e.g., IgG1, IgG2, IgG 3, IgG4, IgA1 and IgA2) or subclass.

The term "Fc region" is used to define the C-terminal region of an immunoglobulin heavy chain, which may be generated by papain digestion of an intact antibody. The Fc region may be a native sequence Fc region or a variant Fc region. The Fc region of an immunoglobulin generally comprises two constant domains, a CH2 domain and a CH3 domain, and optionally comprises a CH4 domain. Replacements of amino acid residues in the Fc portion to alter antibody effector function are known in the art (Winter, et al. U.S. Pat. Nos. 5,648,260 and 5,624,821). The Fc portion of an antibody mediates several important effector functions e.g., cytokine induction, ADCC, phagocytosis, complement dependent cytotoxicity (CDC) and half-life/clearance rate of antibody and antigen-antibody complexes. In some cases these effector functions are desirable for therapeutic antibody but in other cases might be unnecessary or even deleterious, depending on the therapeutic objectives. Certain human IgG isotypes, particularly IgG1 and IgG3, mediate ADCC and CDC via binding to FcγRs and complement C1q, respectively. Neonatal Fc receptors (FcRn) are the critical components determining the circulating half-life of antibodies. In still another embodiment at least one amino acid residue is replaced in the constant region of the antibody, for example the Fc region of the antibody, such that effector functions of the antibody are altered. The dimerization of two identical heavy chains of an immunoglobulin is mediated by the dimerization of CH3 domains and is stabilized by the disulfide bonds within the hinge region (Huber et al. Nature; 264: 415-20; Thies et al 1999 J Mol Biol; 293: 67-79). Mutation of cysteine residues within the hinge regions to prevent heavy chain-heavy chain disulfide bonds will destabilize dimeration of CH3 domains. Residues responsible for CH3 dimerization have been identified (Dall'Acqua 1998 Biochemistry 37: 9266-73). Therefore, it is possible to generate a monovalent half-Ig. Interestingly, these monovalent half Ig molecules have been found in nature for both IgG and IgA subclasses (Seligman 1978 Ann Immunol 129: 855-70; Biewenga et al 1983 Clin Exp Immunol 51: 395-400). The stoichiometry of FcRn:Ig Fc region has been determined to be 2:1 (West et al 0.2000 Biochemistry 39: 9698-708), and half Fc is sufficient for mediating FcRn binding (Kim et al 1994 Eur J Immunol; 24: 542-548). Mutations to disrupt the dimerization of CH3 domain may not have greater adverse effect on its FcRn binding as the residues important for CH3 dimerization are located on the inner interface of CH3 b sheet structure, whereas the region responsible for FcRn binding is located on the outside interface of CH2-CH3 domains. However the half Ig molecule may have certain advantage in tissue penetration due to its smaller size than that of a regular antibody. In one embodiment at least one amino acid residue is replaced in the constant region of the binding protein of the invention, for example the Fc region, such that the dimerization of the heavy chains is disrupted, resulting in half DVD Ig molecules. The anti-inflammatory activity of IgG is completely dependent on sialylation of the N-linked glycan of the IgG Fc fragment. The precise glycan requirements for anti-inflammatory activity has been determined, such that an appropriate IgG1 Fc fragment can be created, thereby generating a recombinant, sialylated IgG1 Fc with greatly enhanced potency (Anthony, R. M., et al. (2008) Science 320:373-376).

The term "antigen-binding portion" of an antibody (or simply "antibody portion"), as used herein, refers to one or more fragments of an antibody that retain the ability to specifically bind to an antigen. It has been shown that the antigen-binding function of an antibody can be performed by fragments of a full-length antibody. Such antibody embodiments may also be bispecific, dual specific, or multi-specific formats; specifically binding to two or more different antigens. Examples of binding fragments encompassed within the term "antigen-binding portion" of an antibody include (i) a Fab fragment, a monovalent fragment consisting of the VL, VH, CL and CH1 domains; (ii) a F(ab')₂ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546, Winter et al., PCT publication WO 90/05144 A1 herein incorporated by reference), which comprises a single variable domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFv); see e.g., Bird et al. (1988) *Science* 242:423-426; and Huston et al. (1988) *Proc. Natl. Acad. Sci. USA* 85:5879-5883). Such single chain antibodies are also intended to be encompassed within the term "antigen-binding portion" of an antibody. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see e.g., Holliger, P., et al. (1993) *Proc. Natl. Acad. Sci. USA* 90:6444-6448; Poljak, R. J., et al. (1994) *Structure* 2:1121-1123). Such antibody binding portions are known in the art (Kontermann and Dubel eds., *Antibody Engineering* (2001) Springer-Verlag. New York. 790 pp. (ISBN 3-540-41354-5). In addition single chain antibodies also include "linear antibodies" comprising a pair of tandem Fv segments (VH-CH1-VH-CH1) which, together with complementary light chain polypeptides, form a pair of antigen binding regions (Zapata et al. Protein Eng. 8(10): 1057-1062 (1995); and U.S. Pat. No. 5,641,870).

The term "multivalent binding protein" is used throughout this specification to denote a binding protein comprising two or more antigen binding sites. In an embodiment, the multivalent binding protein is engineered to have the three or more antigen binding sites, and is generally not a naturally occurring antibody. The term "multispecific binding protein" refers to a binding protein capable of binding two or more related or unrelated targets. Dual variable domain (DVD) binding proteins of the invention comprise two or more antigen binding sites and are tetravalent or multivalent binding proteins. DVDs may be monospecific, i.e., capable of binding one antigen or multispecific, i.e. capable of binding two or more antigens. DVD binding proteins comprising two heavy chain DVD polypeptides and two light chain DVD polypeptides are referred to as DVD-Ig. Each half of a DVD-Ig comprises a heavy chain DVD polypeptide, and a light chain DVD polypeptide, and two antigen binding sites. Each binding site comprises a heavy chain variable domain and a light chain variable domain with a total of 6 CDRs involved in antigen binding per antigen binding site.

The term "bispecific antibody", as used herein, refers to full-length antibodies that are generated by quadroma technology (see Milstein, C. and A. C. Cuello, Nature, 1983. 305(5934): p. 537-40), by chemical conjugation of two different monoclonal antibodies (see Staerz, U. D., et al., Nature, 1985. 314(6012): p. 628-31), or by knob-into-hole or similar approaches which introduces mutations in the Fc region (see Holliger, P., T. Prospero, and G. Winter, Proc Natl Acad Sci USA, 1993. 90(14): p. 6444-8.18), resulting in multiple different immunoglobulin species of which only one is the functional bispecific antibody. By molecular function, a bispecific antibody binds one antigen (or epitope) on one of its two binding arms (one pair of HC/LC), and binds a different antigen (or epitope) on its second arm (a different pair of HC/LC). By this definition, a bispecific antibody has two distinct antigen binding arms (in both specificity and CDR sequences), and is monovalent for each antigen it binds to.

The term "dual-specific antibody", as used herein, refers to full-length antibodies that can bind two different antigens (or epitopes) in each of its two binding arms (a pair of HC/LC) (see PCT publication WO 02/02773). Accordingly a dual-specific binding protein has two identical antigen binding arms, with identical specificity and identical CDR sequences, and is bivalent for each antigen it binds to.

A "functional antigen binding site" of a binding protein is one that is capable of binding a target antigen. The antigen binding affinity of the antigen binding site is not necessarily as strong as the parent antibody from which the antigen binding site is derived, but the ability to bind antigen must be measurable using any one of a variety of methods known for evaluating antibody binding to an antigen. Moreover, the antigen binding affinity of each of the antigen binding sites of a multivalent antibody herein need not be quantitatively the same.

The term "cytokine" is a generic term for proteins released by one cell population, which act on another cell population as intercellular mediators. Examples of such cytokines are lymphokines, monokines, and traditional polypeptide hormones. Included among the cytokines are growth hormone such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor; prolactin; placental lactogen; tumor necrosis factor-alpha and -beta; mullerian-inhibiting substance; mouse gonadotropin-associated peptide; inhibin; activin; vascular endothelial growth factor; integrin; thrombopoietin (TPO); nerve growth factors such as NGF-alpha; platelet-growth factor; placental growth factor, transforming growth factors (TGFs) such as TGF-alpha and TGF-beta; insulin-like growth factor-1 and -11; erythropoietin (EPO); osteoinductive factors; interferons such as interferon-alpha, -beta and -gamma colony stimulating factors (CSFs) such as macrophage-CSF (M-CSF); granulocyte macrophage-CSF (GM-CSF); and granulocyte-CSF (G-CSF); interleukins (ILs) such as IL-1, IL-2, IL-3, IL-4, IL-5, IL-6, IL-7, IL-8, IL-9, IL-10, IL-11, IL-12, IL-13, IL-15, IL-18, IL-21, IL-22, IL-23, IL-33; a tumor necrosis factor such as TNF-alpha or TNF-beta; and other polypeptide factors including LIF and kit ligand (KL). As used herein, the term cytokine includes proteins from natural sources or from recombinant cell culture and biologically active equivalents of the native sequence cytokines.

The term "linker" is used to denote polypeptides comprising two or more amino acid residues joined by peptide bonds and are used to link one or more antigen binding portions. Such linker polypeptides are well known in the art (see e.g., Holliger, P., et al. (1993) Proc. Natl. Acad. Sci. USA 90:6444-6448; Poljak, R. J., et al. (1994) Structure 2:1121-1123). Exemplary linkers include, but are not limited to, AKTTP-KLEEGEFSEAR (SEQ ID NO: 1); AKTTPKLEEGEF-SEARV (SEQ ID NO: 2); AKTTPKLGG (SEQ ID NO: 3); SAKTTPKLGG (SEQ ID NO: 4); SAKTTP (SEQ ID NO: 5); RADAAP (SEQ ID NO: 6); RADAAPTVS (SEQ ID NO: 7); RADAAAAGGPGS (SEQ ID NO: 8); RADAAAA($G_4S$)$_4$ (SEQ ID NO: 9); SAKTTPKLEEGEFSEARV (SEQ ID NO: 10); ADAAP (SEQ ID NO: 11); ADAAPTVSIFPP (SEQ ID NO: 12); TVAAP (SEQ ID NO: 13); TVAAPSVFIFPP (SEQ ID NO: 14); QPKAAP (SEQ ID NO: 15); QPKAAPS-VTLFPP (SEQ ID NO: 16); AKTTPP (SEQ ID NO: 17); AKTTPPSVTPLAP (SEQ ID NO: 18); AKTTAP (SEQ ID NO: 19); AKTTAPSVYPLAP (SEQ ID NO: 20); ASTKGP (SEQ ID NO: 21); ASTKGPSVFPLAP (SEQ ID NO: 22), GGGGSGGGGSGGGGS (SEQ ID NO: 23); GENKVEYA-PALMALS (SEQ ID NO: 24); GPAKELTPLKEAKVS (SEQ ID NO: 25); GHEAAAVMQVQYPAS (SEQ ID NO: 26).

An "immunoglobulin constant domain" refers to a heavy or light chain constant domain. Human IgG heavy chain and light chain constant domain amino acid sequences are known in the art.

The term "monoclonal antibody" or "mAb" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigen. Furthermore, in contrast to polyclonal antibody preparations that typically include different antibodies directed against different determinants (epitopes), each mAb is directed against a single determinant on the antigen. The modifier "monoclonal" is not to be construed as requiring production of the antibody by any particular method.

The term "human antibody", as used herein, is intended to include antibodies having variable and constant regions derived from human germline immunoglobulin sequences. The human antibodies of the invention may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include antibodies in which CDR sequences derived from the germline of another mammalian species, such as a mouse, have been grafted onto human framework sequences.

The term "recombinant human antibody", as used herein, is intended to include all human antibodies that are prepared, expressed, created or isolated by recombinant means, such as antibodies expressed using a recombinant expression vector transfected into a host cell (described further in Section II C, below), antibodies isolated from a recombinant, combinatorial human antibody library (Hoogenboom H. R. (1997) TIB Tech. 15:62-70; Azzazy H., and Highsmith W. E. (2002) Clin. Biochem. 35:425-445; Gavilondo J. V., and Larrick J. W. (2002) BioTechniques 29:128-145; Hoogenboom H., and Chames P. (2000) Immunology Today 21:371-378), antibodies isolated from an animal (e.g., a mouse) that is transgenic for human immunoglobulin genes (see, Taylor, L. D., et al. (1992) Nucl. Acids Res. 20:6287-6295; Kellermann S-A, and Green L. L. (2002) Current Opinion in Biotechnology 13:593-597; Little M. et al. (2000) Immunology Today 21:364-370) or antibodies prepared, expressed, created or isolated by any other means that involves splicing of human immunoglobulin gene sequences to other DNA sequences.

Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo.

An "affinity matured" antibody is an antibody with one or more alterations in one or more CDRs thereof which result an improvement in the affinity of the antibody for antigen, compared to a parent antibody which does not possess those alteration(s). Exemplary affinity matured antibodies will have nanomolar or even picomolar affinities for the target antigen. Affinity matured antibodies are produced by procedures known in the art. Marks et al. BidlTechnology 10:779-783 (1992) describes affinity maturation by VH and VL domain shuffling. Random mutagenesis of CDR and/or framework residues is described by: Barbas et al. Proc Nat. Acad. Sci, USA 91:3809-3813 (1994); Schier et al. Gene 169:147-155 (1995); Yelton et al. J. Immunol. 155:1994-2004 (1995); Jackson et al., J. Immunol. 154(7):3310-9 (1995); Hawkins et al, J. Mol. BioL 226:889-896 (1992) and selective mutation at selective mutagenesis positions, contact or hypermutation positions with an activity enhancing amino acid residue as described in U.S. Pat. No. 6,914,128B1.

The term "chimeric antibody" refers to antibodies which comprise heavy and light chain variable region sequences from one species and constant region sequences from another species, such as antibodies having murine heavy and light chain variable regions linked to human constant regions.

The term "CDR-grafted antibody" refers to antibodies which comprise heavy and light chain variable region sequences from one species but in which the sequences of one or more of the CDR regions of VH and/or VL are replaced with CDR sequences of another species, such as antibodies having murine heavy and light chain variable regions in which one or more of the murine CDRs (e.g., CDR3) has been replaced with human CDR sequences.

The term "humanized antibody" refers to antibodies which comprise heavy and light chain variable region sequences from a non-human species (e.g., a mouse) but in which at least a portion of the VH and/or VL sequence has been altered to be more "human-like", i.e., more similar to human germline variable sequences. One type of humanized antibody is a CDR-grafted antibody, in which human CDR sequences are introduced into non-human VH and VL sequences to replace the corresponding nonhuman CDR sequences. Also "humanized antibody" is an antibody or a variant, derivative, analog or fragment thereof which immunospecifically binds to an antigen of interest and which comprises a framework (FR) region having substantially the amino acid sequence of a human antibody and a complementary determining region (CDR) having substantially the amino acid sequence of a non-human antibody. As used herein, the term "substantially" in the context of a CDR refers to a CDR having an amino acid sequence at least 80%, at least 85%, at least 90%, at least 95%, at least 98% or at least 99% identical to the amino acid sequence of a non-human antibody CDR. A humanized antibody comprises substantially all of at least one, and typically two, variable domains (Fab, Fab', F(ab')2, FabC, Fv) in which all or substantially all of the CDR regions correspond to those of a non-human immunoglobulin (i.e., donor antibody) and all or substantially all of the framework regions are those of a human immunoglobulin consensus sequence. In an embodiment, a humanized antibody also comprises at least a portion of an immunoglobulin constant region (Fc), typically that of a human immunoglobulin. In some embodiments, a humanized antibody contains both the light chain as well as at least the variable domain of a heavy chain. The antibody also may include the CH1, hinge, CH2, CH3, and CH4 regions of the heavy chain. In some embodiments, a humanized antibody only contains a humanized light chain. In some embodiments, a humanized antibody only contains a humanized heavy chain. In specific embodiments, a humanized antibody only contains a humanized variable domain of a light chain and/or humanized heavy chain.

The terms "Kabat numbering", "Kabat definitions" and "Kabat labeling" are used interchangeably herein. These terms, which are recognized in the art, refer to a system of numbering amino acid residues which are more variable (i.e. hypervariable) than other amino acid residues in the heavy and light chain variable regions of an antibody, or an antigen binding portion thereof (Kabat et al. (1971) Ann. NY Acad, Sci. 190:382-391 and, Kabat, E.A., et al. (1991) Sequences of Proteins of Immunological Interest, Fifth Edition, U.S. Department of Health and Human Services, NIH Publication No. 91-3242). For the heavy chain variable region, the hypervariable region ranges from amino acid positions 31 to 35 for CDR1, amino acid positions 50 to 65 for CDR2, and amino acid positions 95 to 102 for CDR3. For the light chain variable region, the hypervariable region ranges from amino acid positions 24 to 34 for CDR1, amino acid positions 50 to 56 for CDR2, and amino acid positions 89 to 97 for CDR3.

As used herein, the term "CDR" refers to the complementarity determining region within antibody variable sequences. There are three CDRs in each of the variable regions of the heavy chain and the light chain, which are designated CDR1, CDR2 and CDR3, for each of the variable regions. The term "CDR set" as used herein refers to a group of three CDRs that occur in a single variable region capable of binding the antigen. The exact boundaries of these CDRs have been defined differently according to different systems. The system described by Kabat (Kabat et al., Sequences of Proteins of Immunological Interest (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia & Lesk, J. Mol. Biol. 196:901-917 (1987) and Chothia et al., Nature 342:877-883 (1989)) found that certain sub-portions within Kabat CDRs adopt nearly identical peptide backbone conformations, despite having great diversity at the level of amino acid sequence. These sub-portions were designated as L1, L2 and L3 or H1, H2 and H3 where the "L" and the "H" designates the light chain and the heavy chains regions, respectively. These regions may be referred to as Chothia CDRs, which have boundaries that overlap with Kabat CDRs. Other boundaries defining CDRs overlapping with the Kabat CDRs have been described by Padlan (FASEB J. 9:133-139 (1995)) and MacCallum (J Mol Biol 262(5):732-45 (1996)). Still other CDR boundary definitions may not strictly follow one of the herein systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although certain embodiments use Kabat or Chothia defined CDRs.

As used herein, the term "framework" or "framework sequence" refers to the remaining sequences of a variable region minus the CDRs. Because the exact definition of a CDR sequence can be determined by different systems, the meaning of a framework sequence is subject to correspondingly different interpretations. The six CDRs (CDR-L1, -L2, and -L3 of light chain and CDR-H1, -H2, and -H3 of heavy chain) also divide the framework regions on the light chain and the heavy chain into four sub-regions (FR1, FR2, FR3 and FR4) on each chain, in which CDR1 is positioned between FR1 and FR2, CDR2 between FR2 and FR3, and CDR3 between FR3 and FR4. Without specifying the particular sub-regions as FR1, FR2, FR3 or FR4, a framework region, as referred by others, represents the combined FR's within the variable region of a single, naturally occurring immunoglobulin chain. As used herein, a FR represents one of the four sub-regions, and FRs represents two or more of the four sub-regions constituting a framework region.

As used herein, the term "germline antibody gene" or "gene fragment" refers to an immunoglobulin sequence encoded by non-lymphoid cells that have not undergone the maturation process that leads to genetic rearrangement and mutation for expression of a particular immunoglobulin. (See, e.g., Shapiro et al., Crit. Rev. Immunol. 22(3): 183-200 (2002); Marchalonis et al., Adv Exp Med. Biol. 484:13-30 (2001)). One of the advantages provided by various embodiments of the present invention stems from the recognition that germline antibody genes are more likely than mature antibody genes to conserve essential amino acid sequence structures characteristic of individuals in the species, hence less likely to be recognized as from a foreign source when used therapeutically in that species.

As used herein, the term "neutralizing" refers to counteracting the biological activity of an antigen when a binding protein specifically binds the antigen. In an embodiment, the neutralizing binding protein binds the cytokine and reduces its biologically activity by at least about 20%, 40%, 60%, 80%, 85% or more.

The term "activity" includes activities such as the binding specificity and affinity of a DVD-Ig for two or more antigens.

The term "epitope" includes any polypeptide determinant capable of specific binding to an immunoglobulin or T-cell receptor. In certain embodiments, epitope determinants include chemically active surface groupings of molecules such as amino acids, sugar side chains, phosphoryl, or sulfonyl, and, in certain embodiments, may have specific three dimensional structural characteristics, and/or specific charge characteristics. An epitope is a region of an antigen that is bound by an antibody. In certain embodiments, an antibody is said to specifically bind an antigen when it recognizes its target antigen in a complex mixture of proteins and/or macromolecules. Antibodies are said to "bind to the same epitope" if the antibodies cross-compete (one prevents the binding or modulating effect of the other). In addition structural definitions of epitopes (overlapping, similar, identical) are informative, but functional definitions are often more relevant as they encompass structural (binding) and functional (modulation, competition) parameters.

The term "surface plasmon resonance", as used herein, refers to an optical phenomenon that allows for the analysis of real-time biospecific interactions by detection of alterations in protein concentrations within a biosensor matrix, for example using the BIAcore® system (BIAcore International AB, a GE Healthcare company, Uppsala, Sweden and Piscataway, N.J.). For further descriptions, see Jönsson, U., et al. (1993) *Ann. Biol. Clin.* 51:19-26; Jönsson, U., et al. (1991) *Biotechniques* 11:620-627; Johnsson, B., et al. (1995) *J. Mol. Recognit.* 8:125-131; and Johnnson, B., et al. (1991) *Anal. Biochem.* 198:268-277.

The term "$K_{on}$", as used herein, is intended to refer to the on rate constant for association of a binding protein (e.g., an antibody) to the antigen to form the, e.g., antibody/antigen complex as is known in the art. The "$K_{on}$" also is known by the terms "association rate constant", or "$k_a$", as used interchangeably herein. This value indicating the binding rate of an antibody to its target antigen or the rate of complex formation between an antibody and antigen also is shown by the equation below:

Antibody("Ab")+Antigen("Ag")→Ab-Ag.

The term "$K_{off}$", as used herein, is intended to refer to the off rate constant for dissociation, or "dissociation rate constant", of a binding protein (e.g., an antibody) from the, e.g., antibody/antigen complex as is known in the art. This value indicates the dissociation rate of an antibody from its target antigen or separation of Ab-Ag complex over time into free antibody and antigen as shown by the equation below:

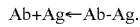
Ab+Ag←Ab-Ag.

The term "$K_D$" as used herein, is intended to refer to the "equilibrium dissociation constant", and refers to the value obtained in a titration measurement at equilibrium, or by dividing the dissociation rate constant ($k_{off}$) by the association rate constant ($k_{on}$). The association rate constant, the dissociation rate constant and the equilibrium dissociation constant are used to represent the binding affinity of an antibody to an antigen. Methods for determining association and dissociation rate constants are well known in the art. Using fluorescence-based techniques offers high sensitivity and the ability to examine samples in physiological buffers at equilibrium. Other experimental approaches and instruments such as a BIAcore® (biomolecular interaction analysis) assay can be used (e.g., instrument available from BIAcore International AB, a GE Healthcare company, Uppsala, Sweden). Additionally, a KinExA® (Kinetic Exclusion Assay) assay, available from Sapidyne Instruments (Boise, Id.) can also be used.

"Label" and "detectable label" mean a moiety attached to a specific binding partner, such as an antibody or an analyte, e.g., to render the reaction between members of a specific binding pair, such as an antibody and an analyte, detectable, and the specific binding partner, e.g., antibody or analyte, so labeled is referred to as "detectably labeled." Thus, the term "labeled binding protein" as used herein, refers to a protein with a label incorporated that provides for the identification of the binding protein. In an embodiment, the label is a detectable marker that can produce a signal that is detectable by visual or instrumental means, e.g., incorporation of a radiolabeled amino acid or attachment to a polypeptide of biotinyl moieties that can be detected by marked avidin (e.g., streptavidin containing a fluorescent marker or enzymatic activity that can be detected by optical or colorimetric methods). Examples of labels for polypeptides include, but are not limited to, the following: radioisotopes or radionuclides (e.g., $^3$H, $^{14}$C, $^{35}$S, $^{90}$Y, $^{99}$Tc, $^{111}$In, $^{125}$I, $^{131}$I, $^{177}$Lu, $^{166}$Ho, or $^{153}$Sm); chromogens, fluorescent labels (e.g., FITC, rhodamine, lanthanide phosphors), enzymatic labels (e.g., horseradish peroxidase, luciferase, alkaline phosphatase); chemiluminescent markers; biotinyl groups; predetermined polypeptide epitopes recognized by a secondary reporter (e.g., leucine zipper pair sequences, binding sites for secondary antibodies, metal binding domains, epitope tags); and magnetic agents, such as gadolinium chelates. Representative examples of labels commonly employed for immunoassays include moieties that produce light, e.g., acridinium compounds, and moieties that produce fluorescence, e.g., fluorescein. Other labels are described herein. In this regard, the moiety itself may not be detectably labeled but may become detectable upon reaction with yet another moiety. Use of "detectably labeled" is intended to encompass the latter type of detectable labeling.

The term "conjugate" refers to a binding protein, such as an antibody, chemically linked to a second chemical moiety, such as a therapeutic or cytotoxic agent. The term "agent" is used herein to denote a chemical compound, a mixture of chemical compounds, a biological macromolecule, or an extract made from biological materials. In an embodiment, the therapeutic or cytotoxic agents include, but are not limited to, pertussis toxin, taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. When employed in the context of an immunoassay, the conjugate antibody may be a detectably labeled antibody used as the detection antibody.

The terms "crystal" and "crystallized" as used herein, refer to a binding protein (e.g., an antibody), or antigen binding portion thereof, that exists in the form of a crystal. Crystals are one form of the solid state of matter, which is distinct from other forms such as the amorphous solid state or the liquid crystalline state. Crystals are composed of regular, repeating, three-dimensional arrays of atoms, ions, molecules (e.g., proteins such as antibodies), or molecular assemblies (e.g., antigen/antibody complexes). These three-dimensional arrays are arranged according to specific mathematical relationships that are well-understood in the field. The fundamental unit, or building block, that is repeated in a crystal is called the asymmetric unit. Repetition of the asymmetric unit in an arrangement that conforms to a given, well-defined crystallographic symmetry provides the "unit cell" of the crystal. Repetition of the unit cell by regular translations in all three dimensions provides the crystal. See Giege, R. and Ducruix, A. Barrett, Crystallization of Nucleic Acids and Proteins, a Practical Approach, 2nd ea., pp. 20 1-16, Oxford University Press, New York, N.Y., (1999)."

The term "polynucleotide" means a polymeric form of two or more nucleotides, either ribonucleotides or deoxynucleotides or a modified form of either type of nucleotide. The term includes single and double stranded forms of DNA.

The term "isolated polynucleotide" shall mean a polynucleotide (e.g., of genomic, cDNA, or synthetic origin, or some combination thereof) that, by virtue of its origin, the "isolated polynucleotide" is not associated with all or a portion of a polynucleotide with which the "isolated polynucleotide" is found in nature; is operably linked to a polynucleotide that it is not linked to in nature; or does not occur in nature as part of a larger sequence.

The term "vector", is intended to refer to a nucleic acid molecule capable of transporting another nucleic acid to which it has been linked. One type of vector is a "plasmid", which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The term "operably linked" refers to a juxtaposition wherein the components described are in a relationship permitting them to function in their intended manner. A control sequence "operably linked" to a coding sequence is ligated in such a way that expression of the coding sequence is achieved under conditions compatible with the control sequences. "Operably linked" sequences include both expression control sequences that are contiguous with the gene of interest and expression control sequences that act in trans or at a distance to control the gene of interest. The term "expression control sequence" as used herein refers to polynucleotide sequences which are necessary to effect the expression and processing of coding sequences to which they are ligated. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (i.e., Kozak consensus sequence); sequences that enhance protein stability; and when desired, sequences that enhance protein secretion. The nature of such control sequences differs depending upon the host organism; in prokaryotes, such control sequences generally include promoter, ribosomal binding site, and transcription termination sequence; in eukaryotes, generally, such control sequences include promoters and transcription termination sequence. The term "control sequences" is intended to include components whose presence is essential for expression and processing, and can also include additional components whose presence is advantageous, for example, leader sequences and fusion partner sequences.

"Transformation", refers to any process by which exogenous DNA enters a host cell. Transformation may occur under natural or artificial conditions using various methods well known in the art. Transformation may rely on any known method for the insertion of foreign nucleic acid sequences into a prokaryotic or eukaryotic host cell. The method is selected based on the host cell being transformed and may include, but is not limited to, viral infection, electroporation, lipofection, and particle bombardment. Such "transformed" cells include stably transformed cells in which the inserted DNA is capable of replication either as an autonomously replicating plasmid or as part of the host chromosome. They also include cells which transiently express the inserted DNA or RNA for limited periods of time.

The term "recombinant host cell" (or simply "host cell"), is intended to refer to a cell into which exogenous DNA has been introduced. It should be understood that such terms are intended to refer not only to the particular subject cell, but, to the progeny of such a cell. Because certain modifications may occur in succeeding generations due to either mutation or environmental influences, such progeny may not, in fact, be identical to the parent cell, but are still included within the scope of the term "host cell" as used herein. In an embodiment, host cells include prokaryotic and eukaryotic cells selected from any of the Kingdoms of life. In another embodiment, eukaryotic cells include protist, fungal, plant and animal cells. In another embodiment, host cells include but are not limited to the prokaryotic cell line *E. Coli*; mammalian cell lines CHO, HEK 293, COS, NS0, SP2 and PER.C6; the insect cell line Sf9; and the fungal cell *Saccharomyces cerevisiae*.

Standard techniques may be used for recombinant DNA, oligonucleotide synthesis, and tissue culture and transformation (e.g., electroporation, lipofection). Enzymatic reactions and purification techniques may be performed according to manufacturer's specifications or as commonly accomplished in the art or as described herein. The foregoing techniques and procedures may be generally performed according to conventional methods well known in the art and as described in various general and more specific references that are cited and discussed throughout the present specification. See e.g., Sambrook et al. Molecular Cloning: A Laboratory Manual (2d ed., Cold Spring Harbor Laboratory Press, Cold Spring Harbor, N.Y. (1989)), which is incorporated herein by reference for any purpose.

"Transgenic organism", as known in the art, refers to an organism having cells that contain a transgene, wherein the transgene introduced into the organism (or an ancestor of the organism) expresses a polypeptide not naturally expressed in the organism. A "transgene" is a DNA construct, which is stably and operably integrated into the genome of a cell from which a transgenic organism develops, directing the expression of an encoded gene product in one or more cell types or tissues of the transgenic organism.

The term "regulate" and "modulate" are used interchangeably, and, as used herein, refers to a change or an alteration in the activity of a molecule of interest (e.g., the biological activity of a cytokine). Modulation may be an increase or a decrease in the magnitude of a certain activity or function of the molecule of interest. Exemplary activities and functions of a molecule include, but are not limited to, binding characteristics, enzymatic activity, cell receptor activation, and signal transduction.

Correspondingly, the term "modulator" is a compound capable of changing or altering an activity or function of a molecule of interest (e.g., the biological activity of a cytokine). For example, a modulator may cause an increase or decrease in the magnitude of a certain activity or function of a molecule compared to the magnitude of the activity or function observed in the absence of the modulator. In certain embodiments, a modulator is an inhibitor, which decreases the magnitude of at least one activity or function of a molecule. Exemplary inhibitors include, but are not limited to, proteins, peptides, antibodies, peptibodies, carbohydrates or small organic molecules. Peptibodies are described, e.g., in WO01/83525.

The term "agonist", refers to a modulator that, when contacted with a molecule of interest, causes an increase in the magnitude of a certain activity or function of the molecule compared to the magnitude of the activity or function observed in the absence of the agonist. Particular agonists of interest may include, but are not limited to, polypeptides, nucleic acids, carbohydrates, or any other molecules that bind to the antigen.

The term "antagonist" or "inhibitor", refer to a modulator that, when contacted with a molecule of interest causes a decrease in the magnitude of a certain activity or function of the molecule compared to the magnitude of the activity or function observed in the absence of the antagonist. Particular antagonists of interest include those that block or modulate the biological or immunological activity of the antigen. Antagonists and inhibitors of antigens may include, but are not limited to, proteins, nucleic acids, carbohydrates, or any other molecules, which bind to the antigen.

As used herein, the term "effective amount" refers to the amount of a therapy which is sufficient to reduce or ameliorate the severity and/or duration of a disorder or one or more symptoms thereof, prevent the advancement of a disorder, cause regression of a disorder, prevent the recurrence, development, onset or progression of one or more symptoms associated with a disorder, detect a disorder, or enhance or improve the prophylactic or therapeutic effect(s) of another therapy (e.g., prophylactic or therapeutic agent).

"Patient" and "subject" may be used interchangeably herein to refer to an animal, such as a mammal, including a primate (for example, a human, a monkey, and a chimpanzee), a non-primate (for example, a cow, a pig, a camel, a llama, a horse, a goat, a rabbit, a sheep, a hamster, a guinea pig, a cat, a dog, a rat, a mouse, a whale), a bird (e.g., a duck or a goose), and a shark. Preferably, the patient or subject is a human, such as a human being treated or assessed for a disease, disorder or condition, a human at risk for a disease, disorder or condition, a human having a disease, disorder or condition, and/or human being treated for a disease, disorder or condition.

The term "sample", as used herein, is used in its broadest sense. A "biological sample", as used herein, includes, but is not limited to, any quantity of a substance from a living thing or formerly living thing. Such living things include, but are not limited to, humans, mice, rats, monkeys, dogs, rabbits and other animals. Such substances include, but are not limited to, blood, (e.g., whole blood), plasma, serum, urine, amniotic fluid, synovial fluid, endothelial cells, leukocytes, monocytes, other cells, organs, tissues, bone marrow, lymph nodes and spleen.

"Component," "components," and "at least one component," refer generally to a capture antibody, a detection or conjugate antibody, a control, a calibrator, a series of calibrators, a sensitivity panel, a container, a buffer, a diluent, a salt, an enzyme, a co-factor for an enzyme, a detection reagent, a pretreatment reagent/solution, a substrate (e.g., as a solution), a stop solution, and the like that can be included in a kit for assay of a test sample, such as a patient urine, serum or plasma sample, in accordance with the methods described herein and other methods known in the art. Thus, in the context of the present disclosure, "at least one component," "component," and "components" can include a polypeptide or other analyte as above, such as a composition comprising an analyte such as polypeptide, which is optionally immobilized on a solid support, such as by binding to an anti-analyte (e.g., anti-polypeptide) antibody. Some components can be in solution or lyophilized for reconstitution for use in an assay.

"Control" refers to a composition known to not analyte ("negative control") or to contain analyte ("positive control"). A positive control can comprise a known concentration of analyte. "Control," "positive control," and "calibrator" may be used interchangeably herein to refer to a composition comprising a known concentration of analyte. A "positive control" can be used to establish assay performance characteristics and is a useful indicator of the integrity of reagents (e.g., analytes).

"Predetermined cutoff" and "predetermined level" refer generally to an assay cutoff value that is used to assess diagnostic/prognostic/therapeutic efficacy results by comparing the assay results against the predetermined cutoff/level, where the predetermined cutoff/level already has been linked or associated with various clinical parameters (e.g., severity of disease, progression/nonprogression/improvement, etc.). While the present disclosure may provide exemplary predetermined levels, it is well-known that cutoff values may vary depending on the nature of the immunoassay (e.g., antibodies employed, etc.). It further is well within the ordinary skill of one in the art to adapt the disclosure herein for other immunoassays to obtain immunoassay-specific cutoff values for those other immunoassays based on this disclosure. Whereas the precise value of the predetermined cutoff/level may vary between assays, correlations as described herein (if any) should be generally applicable.

"Pretreatment reagent," e.g., lysis, precipitation and/or solubilization reagent, as used in a diagnostic assay as described herein is one that lyses any cells and/or solubilizes any analyte that is/are present in a test sample. Pretreatment is not necessary for all samples, as described further herein. Among other things, solubilizing the analyte (e.g., polypeptide of interest) may entail release of the analyte from any endogenous binding proteins present in the sample. A pretreatment reagent may be homogeneous (not requiring a separation step) or heterogeneous (requiring a separation step). With use of a heterogeneous pretreatment reagent there is removal of any precipitated analyte binding proteins from the test sample prior to proceeding to the next step of the assay.

"Quality control reagents" in the context of immunoassays and kits described herein, include, but are not limited to, calibrators, controls, and sensitivity panels. A "calibrator" or "standard" typically is used (e.g., one or more, such as a plurality) in order to establish calibration (standard) curves for interpolation of the concentration of an analyte, such as an antibody or an analyte. Alternatively, a single calibrator, which is near a predetermined positive/negative cutoff, can be used. Multiple calibrators (i.e., more than one calibrator or a varying amount of calibrator(s)) can be used in conjunction so as to comprise a "sensitivity panel."

"Risk" refers to the possibility or probability of a particular event occurring either presently or at some point in the future. "Risk stratification" refers to an array of known clinical risk factors that allows physicians to classify patients into a low, moderate, high or highest risk of developing a particular disease, disorder or condition.

"Specific" and "specificity" in the context of an interaction between members of a specific binding pair (e.g., an antigen (or fragment thereof) and an antibody (or antigenically reactive fragment thereof)) refer to the selective reactivity of the interaction. The phrase "specifically binds to" and analogous phrases refer to the ability of antibodies (or antigenically reactive fragments thereof) to bind specifically to analyte (or a fragment thereof) and not bind specifically to other entities.

"Specific binding partner" is a member of a specific binding pair. A specific binding pair comprises two different molecules, which specifically bind to each other through chemical or physical means. Therefore, in addition to antigen and antibody specific binding pairs of common immunoassays, other specific binding pairs can include biotin and avidin (or streptavidin), carbohydrates and lectins, complementary nucleotide sequences, effector and receptor molecules, cofactors and enzymes, enzyme inhibitors and enzymes, and the like. Furthermore, specific binding pairs can include members that are analogs of the original specific binding members, for example, an analyte-analog Immunoreactive specific binding members include antigens, antigen fragments, and antibodies, including monoclonal and polyclonal antibodies as well as complexes, fragments, and variants (including fragments of variants) thereof, whether isolated or recombinantly produced.

"Variant" as used herein means a polypeptide that differs from a given polypeptide (e.g., IL-18, BNP, NGAL or HIV polypeptide or anti-polypeptide antibody) in amino acid sequence by the addition (e.g., insertion), deletion, or conservative substitution of amino acids, but that retains the biological activity of the given polypeptide (e.g., a variant IL-18 can compete with anti-IL-18 antibody for binding to IL-18). A conservative substitution of an amino acid, i.e., replacing an amino acid with a different amino acid of similar properties (e.g., hydrophilicity and degree and distribution of charged regions) is recognized in the art as typically involving a minor change. These minor changes can be identified, in part, by considering the hydropathic index of amino acids, as understood in the art (see, e.g., Kyte et al., J. Mol. Biol. 157: 105-132 (1982)). The hydropathic index of an amino acid is based on a consideration of its hydrophobicity and charge. It is known in the art that amino acids of similar hydropathic indexes can be substituted and still retain protein function. In one aspect, amino acids having hydropathic indexes of ±2 are substituted. The hydrophilicity of amino acids also can be used to reveal substitutions that would result in proteins retaining biological function. A consideration of the hydrophilicity of amino acids in the context of a peptide permits calculation of the greatest local average hydrophilicity of that peptide, a useful measure that has been reported to correlate well with antigenicity and immunogenicity (see, e.g., U.S. Pat. No. 4,554,101, which is incorporated herein by reference). Substitution of amino acids having similar hydrophilicity values can result in peptides retaining biological activity, for example immunogenicity, as is understood in the art. In one aspect, substitutions are performed with amino acids having hydrophilicity values within ±2 of each other. Both the hydrophobicity index and the hydrophilicity value of amino acids are influenced by the particular side chain of that amino acid. Consistent with that observation, amino acid substitutions that are compatible with biological function are understood to depend on the relative similarity of the amino acids, and particularly the side chains of those amino acids, as revealed by the hydrophobicity, hydrophilicity, charge, size, and other properties. "Variant" also can be used to describe a polypeptide or fragment thereof that has been differentially processed, such as by proteolysis, phosphorylation, or other post-translational modification, yet retains its biological activity or antigen reactivity, e.g., the ability to bind to IL-18. Use of "variant" herein is intended to encompass fragments of a variant unless otherwise contradicted by context.

I. Generation of DVD Binding Protein

The invention pertains to Dual Variable Domain binding proteins capable of binding one or more targets and methods of making the same. In an embodiment, the binding protein comprises a polypeptide chain, wherein said polypeptide chain comprises VD1-(X1)n-VD2-C-(X2)n, wherein VD1 is a first variable domain, VD2 is a second variable domain, C is a constant domain, X1 represents an amino acid or polypeptide, X2 represents an Fc region and n is 0 or 1. The binding protein of the invention can be generated using various techniques. The invention provides expression vectors, host cell and methods of generating the binding protein.

A. Generation of Parent Monoclonal Antibodies

The variable domains of the DVD binding protein can be obtained from parent antibodies, including polyclonal and mAbs capable of binding antigens of interest. These antibodies may be naturally occurring or may be generated by recombinant technology.

MAbs can be prepared using a wide variety of techniques known in the art including the use of hybridoma, recombinant, and phage display technologies, or a combination thereof. For example, mAbs can be produced using hybridoma techniques including those known in the art and taught, for example, in Harlow et al., Antibodies: A Laboratory Manual, (Cold Spring Harbor Laboratory Press, 2nd ed. 1988); Hammerling, et al., in: Monoclonal Antibodies and T-Cell Hybridomas 563-681 (Elsevier, N.Y., 1981) (said references incorporated by reference in their entireties). The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced. Hybridomas are selected, cloned and further screened for desirable characteristics, including robust hybridoma growth, high antibody production and desirable antibody characteristics, as discussed in Example 1 below. Hybridomas may be cultured and expanded in vivo in syngeneic animals, in animals that lack an immune system, e.g., nude mice, or in cell culture in vitro. Methods of selecting, cloning and expanding hybridomas are well known to those of ordinary skill in the art. In a particular embodiment, the hybridomas are mouse hybridomas. In another embodiment, the hybridomas are produced in a non-human, non-mouse species such as rats, sheep, pigs, goats, cattle or horses. In another embodiment, the hybridomas are human hybridomas, in which a human non-secretory myeloma is fused with a human cell expressing an antibody capable of binding a specific antigen.

Recombinant mAbs are also generated from single, isolated lymphocytes using a procedure referred to in the art as the selected lymphocyte antibody method (SLAM), as described in U.S. Pat. No. 5,627,052, PCT Publication WO 92/02551 and Babcock, J. S. et al. (1996) *Proc. Natl. Acad. Sci. USA* 93:7843-7848. In this method, single cells secreting antibodies of interest, e.g., lymphocytes derived from an immunized animal, are identified, and, heavy- and light-chain variable region cDNAs are rescued from the cells by reverse transcriptase-PCR and these variable regions can then be expressed, in the context of appropriate immunoglobulin constant regions (e.g., human constant regions), in mammalian host cells, such as COS or CHO cells. The host cells transfected with the amplified immunoglobulin sequences, derived from in vivo selected lymphocytes, can then undergo further analysis and selection in vitro, for example by panning the transfected cells to isolate cells expressing antibodies to the antigen of interest. The amplified immunoglobulin sequences further can be manipulated in vitro, such as by in vitro affinity maturation methods such as those described in PCT Publication WO 97/29131 and PCT Publication WO 00/56772.

Monoclonal antibodies are also produced by immunizing a non-human animal comprising some, or all, of the human immunoglobulin locus with an antigen of interest. In an embodiment, the non-human animal is a XENOMOUSE transgenic mouse, an engineered mouse strain that comprises large fragments of the human immunoglobulin loci and is deficient in mouse antibody production. See, e.g., Green et al. *Nature Genetics* 7:13-21 (1994) and U.S. Pat. Nos. 5,916,771, 5,939,598, 5,985,615, 5,998,209, 6,075,181, 6,091,001, 6,114,598 and 6,130,364. See also WO 91/10741, published Jul. 25, 1991, WO 94/02602, published Feb. 3, 1994, WO 96/34096 and WO 96/33735, both published Oct. 31, 1996, WO 98/16654, published Apr. 23, 1998, WO 98/24893, published Jun. 11, 1998, WO 98/50433, published Nov. 12, 1998, WO 99/45031, published Sep. 10, 1999, WO 99/53049, published Oct. 21, 1999, WO 00 09560, published Feb. 24, 2000 and WO 00/037504, published Jun. 29, 2000. The XENOMOUSE transgenic mouse produces an adult-like human repertoire of fully human antibodies, and generates antigen-specific human monoclonal antibodies. The XENOMOUSE transgenic mouse contains approximately 80% of the human antibody repertoire through introduction of megabase sized, germline configuration YAC fragments of the human heavy chain loci and x light chain loci. See Mendez et al., *Nature Genetics* 15:146-156 (1997), Green and Jakobovits *J. Exp. Med.* 188:483-495 (1998), the disclosures of which are hereby incorporated by reference.

In vitro methods also can be used to make the parent antibodies, wherein an antibody library is screened to identify an antibody having the desired binding specificity. Methods for such screening of recombinant antibody libraries are well known in the art and include methods described in, for example, Ladner et al. U.S. Pat. No. 5,223,409; Kang et al. PCT Publication No. WO 92/18619; Dower et al. PCT Publication No. WO 91/17271; Winter et al. PCT Publication No. WO 92/20791; Markland et al. PCT Publication No. WO 92/15679; Breitling et al. PCT Publication No. WO 93/01288; McCafferty et al. PCT Publication No. WO 92/01047; Garrard et al. PCT Publication No. WO 92/09690; Fuchs et al. (1991) *Bio/Technology* 9:1370-1372; Hay et al. (1992) *Hum Antibod Hybridomas* 3:81-85; Huse et al. (1989) *Science* 246:1275-1281; McCafferty et al., *Nature* (1990) 348:552-554; Griffiths et al. (1993) *EMBO J* 12:725-734; Hawkins et al. (1992) *J Mol Biol* 226:889-896; Clackson et al. (1991) *Nature* 352:624-628; Gram et al. (1992) *PNAS* 89:3576-3580; Garrad et al. (1991) *Bio/Technology* 9:1373-1377; Hoogenboom et al. (1991) *Nuc Acid Res* 19:4133-4137; and Barbas et al. (1991) *PNAS* 88:7978-7982, US patent application publication 20030186374, and PCT Publication No. WO 97/29131, the contents of each of which are incorporated herein by reference.

Parent antibodies of the present invention can also be generated using various phage display methods known in the art. In phage display methods, functional antibody domains are displayed on the surface of phage particles which carry the polynucleotide sequences encoding them. In a particular, such phage can be utilized to display antigen-binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv or disulfide stabilized Fv antibody domains recombinantly fused to either the phage gene III or gene VIII protein. Examples of phage display methods that can be used to make the antibodies of the present invention include those disclosed in Brinkman et al., J. Immunol. Methods 182:41-50 (1995); Ames et al., J. Immunol. Methods 184:177-186 (1995); Kettleborough et al., Eur. J. Immunol. 24:952-958 (1994); Persic et al., Gene 187 9-18 (1997); Burton et al., Advances in Immunology 57:191-280 (1994); PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780, 225; 5,658,727; 5,733,743 and 5,969,108; each of which is incorporated herein by reference in its entirety.

As described in the herein references, after phage selection, the antibody coding regions from the phage can be isolated and used to generate whole antibodies including human antibodies or any other desired antigen binding fragment, and expressed in any desired host, including mammalian cells, insect cells, plant cells, yeast, and bacteria, e.g., as described in detail below. For example, techniques to recombinantly produce Fab, Fab' and F(ab')$_2$ fragments can also be employed using methods known in the art such as those disclosed in PCT publication WO 92/22324; Mullinax et al., BioTechniques 12(6):864-869 (1992); and Sawai et al., AJRI 34:26-34 (1995); and Better et al., Science 240:1041-1043 (1988) (said references incorporated by reference in their entireties). Examples of techniques which can be used to produce single-chain Fvs and antibodies include those described in U.S. Pat. Nos. 4,946,778 and 5,258,498; Huston et al., Methods in Enzymology 203:46-88 (1991); Shu et al., PNAS 90:7995-7999 (1993); and Skerra et al., Science 240: 1038-1040 (1988).

Alternative to screening of recombinant antibody libraries by phage display, other methodologies known in the art for screening large combinatorial libraries can be applied to the identification of parent antibodies. One type of alternative expression system is one in which the recombinant antibody library is expressed as RNA-protein fusions, as described in PCT Publication No. WO 98/31700 by Szostak and Roberts, and in Roberts, R. W. and Szostak, J. W. (1997) Proc. Natl. Acad. Sci. USA 94:12297-12302. In this system, a covalent fusion is created between an mRNA and the peptide or protein that it encodes by in vitro translation of synthetic mRNAs that carry puromycin, a peptidyl acceptor antibiotic, at their 3' end. Thus, a specific mRNA can be enriched from a complex mixture of mRNAs (e.g., a combinatorial library) based on the properties of the encoded peptide or protein, e.g., antibody, or portion thereof, such as binding of the antibody, or portion thereof, to the dual specificity antigen. Nucleic acid sequences encoding antibodies, or portions thereof, recovered from screening of such libraries can be expressed by recombinant means as described herein (e.g., in mammalian host cells) and, moreover, can be subjected to further affinity maturation by either additional rounds of screening of mRNA-peptide fusions in which mutations have been introduced into the originally selected sequence(s), or by other methods for affinity maturation in vitro of recombinant antibodies, as described herein.

In another approach the parent antibodies can also be generated using yeast display methods known in the art. In yeast display methods, genetic methods are used to tether antibody domains to the yeast cell wall and display them on the surface of yeast. In particular, such yeast can be utilized to display antigen-binding domains expressed from a repertoire or combinatorial antibody library (e.g., human or murine). Examples of yeast display methods that can be used to make the parent antibodies include those disclosed in Wittrup, et al. U.S. Pat. No. 6,699,658 incorporated herein by reference.

The antibodies described herein can be further modified to generate CDR grafted and humanized parent antibodies. CDR-grafted parent antibodies comprise heavy and light chain variable region sequences from a human antibody wherein one or more of the CDR regions of $V_H$ and/or $V_L$ are replaced with CDR sequences of murine antibodies capable of binding antigen of interest. A framework sequence from any human antibody may serve as the template for CDR grafting. However, straight chain replacement onto such a framework often leads to some loss of binding affinity to the antigen. The more homologous a human antibody is to the original murine antibody, the less likely the possibility that combining the murine CDRs with the human framework will introduce distortions in the CDRs that could reduce affinity. Therefore, in an embodiment, the human variable framework that is chosen to replace the murine variable framework apart from the CDRs have at least a 65% sequence identity with the murine antibody variable region framework. In an embodiment, the human and murine variable regions apart from the CDRs have at least 70% sequence identify. In a particular embodiment, that the human and murine variable regions apart from the CDRs have at least 75% sequence identity. In another embodiment, the human and murine variable regions apart from the CDRs have at least 80% sequence identity. Methods for producing such antibodies are known in the art (see EP 239,400; PCT publication WO 91/09967; U.S. Pat. Nos. 5,225,539; 5,530,101; and 5,585,089), veneering or resurfacing (EP 592,106; EP 519,596; Padlan, Molecular Immunology 28(4/5):489-498 (1991); Studnicka et al., Protein Engineering 7(6):805-814 (1994); Roguska et al., PNAS 91:969-973 (1994)), and chain shuffling (U.S. Pat. No. 5,565, 352); and anti-idiotypic antibodies.

Humanized antibodies are antibody molecules from non-human species antibody that binds the desired antigen having one or more complementarity determining regions (CDRs) from the non-human species and framework regions from a human immunoglobulin molecule. Known human Ig sequences are disclosed, e.g., by the U.S. National Library of Medicine National Institutes of Health, the American Type Culture Collection, SciQuest®, Abcam®, the Antibody Resource Page, Iowa State University, Heidelberg University, W.H. Freeman, Oracle® ThinkQuest, the Howard Hughes Medical Institute, the University of Cambridge, Harvard University Department of Molecular and Cellular Biology, the Immunology Link, Washington University in St. Louis School of Medicine, the University of Florida, Pebio, the United States Department of Agriculture National Agricultural Library, Ehime University, Meridian Life Science®, Inc., the International Society for Advancement of Cytometry, the Technische Universitat Braunschweig, the MRC Centre for Protein Engineering, the UNAM Biology Institute, ImMunoGeneTics, the University College London Research Department of Structural and Molecular Biology, the University of Bath's Center for Protein Analysis and Design Web Antibody Modelling, the All India Institute of Medical Sciences Department of Biochemistry, the University of Zurich, Department of Biological Sciences Birkbeck University of London, the Medical Research Counsel of the National Institute for Medical Research, the University of Missouri, IBM, and Kabat et al., Sequences of Proteins of Immunological Interest, U.S. Dept. Health (1983), which is entirely incorporated herein by reference. Such imported sequences can be used to reduce immunogenicity or reduce, enhance or modify binding, affinity, on-rate, off-rate, avidity, specificity, half-life, or any other suitable characteristic, as known in the art.

Framework residues in the human framework regions may be substituted with the corresponding residue from the CDR donor antibody to alter, e.g., improve, antigen binding. These framework substitutions are identified by methods well known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; Riechmann et al., Nature 332:323 (1988), which are incorporated herein by reference in their entireties.) Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the consensus and import sequences so that the desired antibody characteristic, such as increased affinity for the target antigen(s), is achieved. In general, the CDR residues are directly and most substantially involved in influencing antigen binding. Antibodies can be humanized using a variety of techniques known in the art, such as but not limited to those described in Jones et al., Nature 321:522 (1986); Verhoeyen et al., Science 239:1534 (1988)), Sims et al., J. Immunol. 151: 2296 (1993); Chothia and Lesk, J. Mol. Biol. 196:901 (1987), Carter et al., Proc. Natl. Acad. Sci. U.S.A. 89:4285 (1992); Presta et al., J. Immunol. 151:2623 (1993), Padlan, Molecular Immunology 28(4/5):489-498 (1991); Studnicka et al., Protein Engineering 7(6):805-814 (1994); Roguska, et al., PNAS 91:969-973 (1994); PCT publication WO 91/09967, PCT/: US98/16280, US96/18978, US91/09630, US91/05939, US94/01234, GB89/01334, GB91/01134, GB92/01755; WO90/14443, WO90/14424, WO90/14430, EP 229246, EP 592,106; EP 519,596, EP 239,400, U.S. Pat. Nos. 5,565,332, 5,723,323, 5,976,862, 5,824,514, 5,817,483, 5,814,476, 5,763,192, 5,723,323, 5,766,886, 5,714,352, 6,204,023, 6,180,370, 5,693,762, 5,530,101, 5,585,089, 5,225,539; 4,816,567, each entirely incorporated herein by reference, included references cited therein.

B. Criteria for Selecting Parent Monoclonal Antibodies

An embodiment of the invention pertains to selecting parent antibodies with at least one or more properties desired in the DVD-Ig molecule. In an embodiment, the desired property is selected from one or more antibody parameters. In another embodiment, the antibody parameters are selected from the group consisting of antigen specificity, affinity to antigen, potency, biological function, epitope recognition, stability, solubility, production efficiency, immunogenicity, pharmacokinetics, bioavailability, tissue cross reactivity, and orthologous antigen binding.

B1. Affinity to Antigen

The desired affinity of a therapeutic mAb may depend upon the nature of the antigen, and the desired therapeutic endpoint. In an embodiment, monoclonal antibodies have higher affinities (Kd=0.01-0.50 pM) when blocking a cytokine-cytokine receptor interaction as such interaction are usually high affinity interactions (e.g., <pM-<nM ranges). In such instances, the mAb affinity for its target should be equal to or better than the affinity of the cytokine (ligand) for its receptor. On the other hand, mAb with lesser affinity (>nM range) could be therapeutically effective e.g., in clearing circulating potentially pathogenic proteins e.g., monoclonal antibodies that bind to, sequester, and clear circulating species of A-β amyloid. In other instances, reducing the affinity of an existing high affinity mAb by site-directed mutagenesis or using a mAb with lower affinity for its target could be used to avoid potential side-effects e.g., a high affinity mAb may sequester/neutralize all of its intended target, thereby completely depleting/eliminating the function(s) of the targeted protein. In this scenario, a low affinity mAb may sequester/neutralize a fraction of the target that may be responsible for the disease symptoms (the pathological or over-produced levels), thus allowing a fraction of the target to continue to perform its normal physiological function(s). Therefore, it may be possible to reduce the Kd to adjust dose and/or reduce side-effects. The affinity of the parental mAb might play a role in appropriately targeting cell surface molecules to achieve desired therapeutic out-come. For example, if a target is expressed on cancer cells with high density and on normal cells with low density, a lower affinity mAb will bind a greater number of targets on tumor cells than normal cells, resulting in tumor cell elimination via ADCC or CDC, and therefore might have therapeutically desirable effects. Thus selecting a mAb with desired affinity may be relevant for both soluble and surface targets.

Signaling through a receptor upon interaction with its ligand may depend upon the affinity of the receptor-ligand interaction. Similarly, it is conceivable that the affinity of a mAb for a surface receptor could determine the nature of intracellular signaling and whether the mAb may deliver an agonist or an antagonist signal. The affinity-based nature of mAb-mediated signaling may have an impact of its side-effect profile. Therefore, the desired affinity and desired functions of therapeutic monoclonal antibodies need to be determined carefully by in vitro and in vivo experimentation.

The desired Kd of a binding protein (e.g., an antibody) may be determined experimentally depending on the desired therapeutic outcome. In an embodiment parent antibodies with affinity (Kd) for a particular antigen equal to, or better than, the desired affinity of the DVD-Ig for the same antigen are selected. The antigen binding affinity and kinetics are assessed by Biacore or another similar technique. In one embodiment, each parent antibody has a dissociation constant (Kd) to its antigen selected from the group consisting of: at most about $10^{-7}$ M; at most about $10^{-8}$ M; at most about $10^{-9}$ M; at most about $10^{-10}$ M; at most about $10^{-11}$ M; at most about $10^{-12}$ M; and at most $10^{-13}$ M. First parent antibody from which VD1 is obtained and second parent antibody from which VD2 is obtained may have similar or different affinity ($K_D$) for the respective antigen. Each parent antibody has an on rate constant (Kon) to the antigen selected from the group consisting of: at least about $10^2 M^{-1}s^{-1}$; at least about $10^3 M^{-1}s^{-1}$; at least about $10^4 M^{-1}s^{-1}$; at least about $10^5 M^{-1}s^{-1}$; and at least about $10^6 M^{-1}s^{-1}$, as measured by surface plasmon resonance. The first parent antibody from which VD1 is obtained and the second parent antibody from which VD2 is obtained may have similar or different on rate constant (Kon) for the respective antigen. In one embodiment, each parent antibody has an off rate constant (Koff) to the antigen selected from the group consisting of: at most about $10^{-3}$ s$^{-1}$; at most about $10^{-4}$ s$^{-1}$; at most about $10^{-5}$ s$^{-1}$; and at most about $10^{-6}$ s$^{-1}$, as measured by surface plasmon resonance. The first parent antibody from which VD1 is obtained and the second parent antibody from which VD2 is obtained may have similar or different off rate constants (Koff) for the respective antigen.

B2. Potency

The desired affinity/potency of parental monoclonal antibodies will depend on the desired therapeutic outcome. For example, for receptor-ligand (R-L) interactions the affinity (kd) is equal to or better than the R-L kd (pM range). For simple clearance of a pathologic circulating protein, the kd could be in low nM range e.g., clearance of various species of circulating A-β peptide. In addition, the kd will also depend on whether the target expresses multiple copies of the same epitope e.g. a mAb targeting conformational epitope in Aβ oligomers.

Where VD1 and VD2 bind the same antigen, but distinct epitopes, the DVD-Ig will contain 4 binding sites for the same antigen, thus increasing avidity and thereby the apparent kd of the DVD-Ig. In an embodiment, parent antibodies with equal or lower kd than that desired in the DVD-Ig are chosen. The affinity considerations of a parental mAb may also depend upon whether the DVD-Ig contains four or more identical antigen binding sites (i.e.; a DVD-Ig from a single mAb). In this case, the apparent kd would be greater than the mAb due to avidity. Such DVD-Igs can be employed for cross-linking surface receptor, increase neutralization potency, enhance clearance of pathological proteins etc.

In an embodiment parent antibodies with neutralization potency for specific antigen equal to or better than the desired neutralization potential of the DVD-Ig for the same antigen are selected. The neutralization potency can be assessed by a target-dependent bioassay where cells of appropriate type produce a measurable signal (i.e. proliferation or cytokine production) in response to target stimulation, and target neutralization by the mAb can reduce the signal in a dose-dependent manner.

B3. Biological Functions

Monoclonal antibodies can perform potentially several functions. Some of these functions are listed in Table 1. These functions can be assessed by both in vitro assays (e.g., cell-based and biochemical assays) and in vivo animal models.

TABLE 1

Some Potential Applications For Therapeutic Antibodies

| Target (Class) | Mechanism of Action (target) |
| --- | --- |
| Soluble (cytokines, other) | Neutralization of activity (e.g., a cytokine) Enhance clearance (e.g., Aβ oligomers) Increase half-life (e.g., GLP 1) |
| Cell Surface (Receptors, other) | Agonist (e.g., GLP1 R; EPO R; etc.) Antagonist (e.g., integrins; etc.) Cytotoxic (CD 20; etc.) |
| Protein deposits | Enhance clearance/degradation (e.g., Aβ plaques, amyloid deposits) |

MAbs with distinct functions described in the examples herein in Table 1 can be selected to achieve desired therapeutic outcomes. Two or more selected parent monoclonal antibodies can then be used in DVD-Ig format to achieve two distinct functions in a single DVD-Ig molecule. For example, a DVD-Ig can be generated by selecting a parent mAb that neutralizes function of a specific cytokine, and selecting a parent mAb that enhances clearance of a pathological protein. Similarly, we can select two parent monoclonal antibodies that recognize two different cell surface receptors, one mAb with an agonist function on one receptor and the other mAb with an antagonist function on a different receptor. These two selected monoclonal antibodies each with a distinct function can be used to construct a single DVD-Ig molecule that will possess the two distinct functions (agonist and antagonist) of the selected monoclonal antibodies in a single molecule. Similarly, two antagonistic monoclonal antibodies to cell surface receptors each blocking binding of respective receptor ligands (e.g., EGF and IGF) can be used in a DVD-Ig format. Conversely, an antagonistic anti-receptor mAb (e.g., anti-EGFR) and a neutralizing anti-soluble mediator (e.g., anti-IGF1/2) mAb can be selected to make a DVD-Ig.

B4. Epitope Recognition:

Different regions of proteins may perform different functions. For example specific regions of a cytokine interact with the cytokine receptor to bring about receptor activation whereas other regions of the protein may be required for stabilizing the cytokine. In this instance one may select a mAb that binds specifically to the receptor interacting region(s) on the cytokine and thereby block cytokine-receptor interaction. In some cases, for example certain chemokine receptors that bind multiple ligands, a mAb that binds to the epitope (region on chemokine receptor) that interacts with only one ligand can be selected. In other instances, monoclonal antibodies can bind to epitopes on a target that are not directly responsible for physiological functions of the protein, but binding of a mAb to these regions could either interfere with physiological functions (steric hindrance) or alter the conformation of the protein such that the protein cannot function (mAb to receptors with multiple ligand which alter the receptor conformation such that none of the ligand can bind). Anti-cytokine monoclonal antibodies that do not block binding of the cytokine to its receptor, but block signal transduction have also been identified (e.g., 125-2H, an anti-IL-18 mAb).

Examples of epitopes and mAb functions include, but are not limited to, blocking Receptor-Ligand (R-L) interaction (neutralizing mAb that binds R-interacting site); steric hindrance resulting in diminished or no R-binding. An Ab can bind the target at a site other than a receptor binding site, but still interferes with receptor binding and functions of the target by inducing conformational change and eliminate function (e.g., Xolair), binding to R but block signaling (125-2H).

In an embodiment, the parental mAb needs to target the appropriate epitope for maximum efficacy. Such epitope should be conserved in the DVD-Ig. The binding epitope of a mAb can be determined by several approaches, including co-crystallography, limited proteolysis of mAb-antigen complex plus mass spectrometric peptide mapping (Legros V. et al 2000 Protein Sci. 9:1002-10), phage displayed peptide libraries (O'Connor K H et al 2005 J Immunol Methods. 299:21-35), as well as mutagenesis (Wu C. et al. 2003 J Immunol 170:5571-7).

B5. Physicochemical and Pharmaceutical Properties:

Therapeutic treatment with antibodies often requires administration of high doses, often several mg/kg (due to a low potency on a mass basis as a consequence of a typically large molecular weight). In order to accommodate patient compliance and to adequately address chronic disease therapies and outpatient treatment, subcutaneous (s.c.) or intramuscular (i.m.) administration of therapeutic mAbs is desirable. For example, the maximum desirable volume for s.c. administration is ~1.0 mL, and therefore, concentrations of >100 mg/mL are desirable to limit the number of injections per dose. In an embodiment, the therapeutic antibody is administered in one dose. The development of such formulations is constrained, however, by protein-protein interactions (e.g., aggregation, which potentially increases immunogenicity risks) and by limitations during processing and delivery (e.g., viscosity). Consequently, the large quantities required for clinical efficacy and the associated development constraints limit full exploitation of the potential of antibody formulation and s.c. administration in high-dose regimens. It is apparent that the physicochemical and pharmaceutical properties of a protein molecule and the protein solution are of utmost importance, e.g., stability, solubility and viscosity features.

B5.1. Stability:

A "stable" antibody formulation is one in which the antibody therein essentially retains its physical stability and/or chemical stability and/or biological activity upon storage. Stability can be measured at a selected temperature for a selected time period. In an embodiment the antibody in the formulation is stable at room temperature (about 30° C.) or at 40° C. for at least 1 month and/or stable at about 2-8° C. for at least 1 year for at least 2 years. Furthermore, in an embodiment, the formulation is stable following freezing (to, e.g., −70° C.) and thawing of the formulation, hereinafter referred to as a "freeze/thaw cycle." In another example, a "stable" formulation may be one wherein less than about 10% and less than about 5% of the protein is present as an aggregate in the formulation.

A DVD-Ig stable in vitro at various temperatures for an extended time period is desirable. One can achieve this by rapid screening of parental mAbs stable in vitro at elevated temperature, e.g., at 40° C. for 2-4 weeks, and then assess stability. During storage at 2-8° C., the protein reveals stability for at least 12 months, e.g., at least 24 months. Stability (% of monomeric, intact molecule) can be assessed using various techniques such as cation exchange chromatography, size exclusion chromatography, SDS-PAGE, as well as bioactivity testing. For a more comprehensive list of analytical techniques that may be employed to analyze covalent and conformational modifications please see Jones, A. J. S. (1993) Analytical methods for the assessment of protein formulations and delivery systems. In: Cleland, J. L.; Langer, R., editors. Formulation and delivery of peptides and proteins, 1$^{st}$ edition, Washington, ACS, pg. 22-45; and Pearlman, R.; Nguyen, T. H. (1990) Analysis of protein drugs. In: Lee, V. H., editor. Peptide and protein drug delivery, 1st edition, New York, Marcel Dekker, Inc., pg. 247-301.

Heterogeneity and aggregate formation: stability of the antibody may be such that the formulation may reveal less than about 10%, and, in an embodiment, less than about 5%, in another embodiment, less than about 2%, or, in an embodiment, within the range of 0.5% to 1.5% or less in the GMP antibody material that is present as aggregate. Size exclusion chromatography is a method that is sensitive, reproducible, and very robust in the detection of protein aggregates.

In addition to low aggregate levels, the antibody must, in an embodiment, be chemically stable. Chemical stability may be determined by ion exchange chromatography (e.g., cation or anion exchange chromatography), hydrophobic interaction chromatography, or other methods such as isoelectric focusing or capillary electrophoresis. For instance, chemical stability of the antibody may be such that after storage of at least 12 months at 2-8° C. the peak representing unmodified antibody in a cation exchange chromatography may increase not more than 20%, in an embodiment, not more than 10%, or, in another embodiment, not more than 5% as compared to the antibody solution prior to storage testing.

In an embodiment, the parent antibodies display structural integrity; correct disulfide bond formation, and correct folding: Chemical instability due to changes in secondary or tertiary structure of an antibody may impact antibody activity. For instance, stability as indicated by activity of the antibody may be such that after storage of at least 12 months at 2-8° C. the activity of the antibody may decrease not more than 50%, in an embodiment not more than 30%, or even not more than 10%, or in an embodiment not more than 5% or 1% as compared to the antibody solution prior to storage testing. Suitable antigen-binding assays can be employed to determine antibody activity.

B5.2. Solubility:

The "solubility" of a mAb correlates with the production of correctly folded, monomeric IgG. The solubility of the IgG may therefore be assessed by HPLC. For example, soluble (monomeric) IgG will give rise to a single peak on the HPLC chromatograph, whereas insoluble (e.g., multimeric and aggregated) will give rise to a plurality of peaks. A person skilled in the art will therefore be able to detect an increase or decrease in solubility of an IgG using routine HPLC techniques. For a more comprehensive list of analytical techniques that may be employed to analyze solubility (see Jones, A. G. Dep. Chem. Biochem. Eng., Univ. Coll. London, London, UK. Editor(s): Shamlou, P. Ayazi. Process. Solid-Liq. Suspensions (1993), 93-117. Publisher: Butterworth-Heinemann, Oxford, UK and Pearlman, Rodney; Nguyen, Tue H, Advances in Parenteral Sciences (1990), 4 (Pept. Protein Drug Delivery), 247-301). Solubility of a therapeutic mAb is critical for formulating to high concentration often required for adequate dosing. As outlined herein, solubilities of >100 mg/mL may be required to accommodate efficient antibody dosing. For instance, antibody solubility may be not less than about 5 mg/mL in early research phase, in an embodiment not less than about 25 mg/mL in advanced process science stages, or in an embodiment not less than about 100 mg/mL, or in an embodiment not less than about 150 mg/mL. It is obvious to a person skilled in the art that the intrinsic properties of a protein molecule are important the physico-chemical properties of the protein solution, e.g., stability, solubility, viscosity. However, a person skilled in the art will appreciate that a broad variety of excipients exist that may be used as additives to beneficially impact the characteristics of the final protein formulation. These excipients may include: (i) liquid solvents, cosolvents (e.g., alcohols such as ethanol); (ii) buffering agents (e.g., phosphate, acetate, citrate, amino acid buffers); (iii) sugars or sugar alcohols (e.g., sucrose, trehalose, fructose, raffinose, mannitol, sorbitol, dextrans); (iv) surfactants (e.g., polysorbate 20, 40, 60, 80, poloxamers); (v) isotonicity modifiers (e.g., salts such as NaCl, sugars, sugar alcohols); and (vi) others (e.g., preservatives, chelating agents, antioxidants, chelating substances (e.g., EDTA), biodegradable polymers, carrier molecules (e.g., HSA, PEGs)

Viscosity is a parameter of high importance with regard to antibody manufacture and antibody processing (e.g., diafiltration/ultrafiltration), fill-finish processes (pumping aspects, filtration aspects) and delivery aspects (syringeability, sophisticated device delivery). Low viscosities enable the liquid solution of the antibody having a higher concentration. This enables the same dose may be administered in smaller volumes. Small injection volumes inhere the advantage of lower pain on injection sensations, and the solutions not necessarily have to be isotonic to reduce pain on injection in the patient. The viscosity of the antibody solution may be such that at shear rates of 100 (1/s) antibody solution viscosity is below 200 mPa s, in an embodiment below 125 mPa s, in another embodiment below 70 mPa s, and in yet another embodiment below 25 mPa s or even below 10 mPa s.

B 5.3. Production Efficiency

The generation of a DVD-Ig that is efficiently expressed in mammalian cells, such as Chinese hamster ovary cells (CHO), will in an embodiment require two parental monoclonal antibodies which are themselves expressed efficiently in mammalian cells. The production yield from a stable mammalian line (i.e. CHO) should be above about 0.5 g/L, in an embodiment above about 1 g/L, and in another embodiment in the range of from about 2-5 g/L or more (Kipriyanov S M, Little M. 1999 Mol. Biotechnol. 12:173-201; Carroll S, Al-Rubeai M. 2004 Expert Opin Biol Ther. 4:1821-9).

Production of antibodies and Ig fusion proteins in mammalian cells is influenced by several factors. Engineering of the expression vector via incorporation of strong promoters, enhancers and selection markers can maximize transcription of the gene of interest from an integrated vector copy. The identification of vector integration sites that are permissive for high levels of gene transcription can augment protein expression from a vector (Wurm et al, 2004, Nature Biotechnology, 2004, Vol/Iss/Pg. 22/11 (1393-1398)). Furthermore, levels of production are affected by the ratio of antibody heavy and light chains and various steps in the process of protein assembly and secretion (Jiang et al. 2006, Biotechnology Progress, January-February 2006, vol. 22, no. 1, p. 313-8).

B 6. Immunogenicity

Administration of a therapeutic mAb may results in certain incidence of an immune response (i.e., the formation of endogenous antibodies directed against the therapeutic mAb). Potential elements that might induce immunogenicity should be analyzed during selection of the parental monoclonal antibodies, and steps to reduce such risk can be taken to optimize the parental monoclonal antibodies prior to DVD-Ig construction. Mouse-derived antibodies have been found to be highly immunogenic in patients. The generation of chimeric antibodies comprised of mouse variable and human constant regions presents a logical next step to reduce the immunogenicity of therapeutic antibodies (Morrison and Schlom, 1990). Alternatively, immunogenicity can be reduced by transferring murine CDR sequences into a human antibody framework (reshaping/CDR grafting/humanization), as described for a therapeutic antibody by Riechmann et al., 1988. Another method is referred to as "resurfacing" or "veneering", starting with the rodent variable light and heavy domains, only surface-accessible framework amino acids are altered to human ones, while the CDR and buried amino acids remain from the parental rodent antibody (Roguska et al., 1996). In another type of humanization, instead of grafting the entire CDRs, one technique grafts only the "specificity-determining regions" (SDRs), defined as the subset of CDR residues that are involved in binding of the antibody to its target (Kashmiri et al., 2005). This necessitates identification of the SDRs either through analysis of available three-dimensional structures of antibody-target complexes or mutational analysis of the antibody CDR residues to determine which interact with the target. Alternatively, fully human antibodies may have reduced immunogenicity compared to murine, chimeric or humanized antibodies.

Another approach to reduce the immunogenicity of therapeutic antibodies is the elimination of certain specific sequences that are predicted to be immunogenic. In one approach, after a first generation biologic has been tested in humans and found to be unacceptably immunogenic, the B-cell epitopes can be mapped and then altered to avoid immune detection. Another approach uses methods to predict and remove potential T-cell epitopes. Computational methods have been developed to scan and to identify the peptide sequences of biologic therapeutics with the potential to bind to MHC proteins (Desmet et al., 2005). Alternatively a human dendritic cell-based method can be used to identify CD4$^+$ T-cell epitopes in potential protein allergens (Stickler et al., 2005; S. L. Morrison and J. Schlom, *Important Adv. Oncol.* (1990), pp. 3-18; Riechmann, L., Clark, M., Waldmann, H. and Winter, G. "*Reshaping human antibodies for therapy.*" Nature (1988) 332: 323-327; Roguska-M-A, Pedersen-J-T, Henry-A-H, Searle-S-M, Roja-C-M, Avery-B, Hoffee-M, Cook-S, Lambert-J-M, Blättler-W-A, Rees-A-R, Guild-B-C. A comparison of two murine mAbs humanized by CDR-grafting and variable domain resurfacing. Protein engineering, {Protein-Eng}, 1996, vol. 9, p. 895-904; Kashmiri-Syed-V-S, De-Pascalis-Roberto, Gonzales-Noreen-R, Schlom-Jeffrey. SDR grafting—a new approach to antibody humanization. Methods (San Diego Calif.), {Methods}, May 2005, vol. 36, no. 1, p. 25-34; Desmet-Johan, Meersseman-Geert, Boutonnet-Nathalie, Pletinckx-Jurgen, De-Clercq-Krista, Debulpaep-Maja, Braeckman-Tessa, Lasters-Ignace. Anchor profiles of HLA-specific peptides: analysis by a novel affinity scoring method and experimental validation. Proteins, 2005, vol. 58, p. 53-69; Stickler-M-M, Estell-D-A, Harding-F-A. CD4+ T-cell epitope determination using unexposed human donor peripheral blood mononuclear cells. Journal of immunotherapy 2000, vol. 23, p. 654-60.)

B 7. In Vivo Efficacy

To generate a DVD-Ig molecule with desired in vivo efficacy, it is important to generate and select mAbs with similarly desired in vivo efficacy when given in combination. However, in some instances the DVD-Ig may exhibit in vivo efficacy that cannot be achieved with the combination of two separate mAbs. For instance, a DVD-Ig may bring two targets in close proximity leading to an activity that cannot be achieved with the combination of two separate mAbs. Additional desirable biological functions are described herein in section B 3. Parent antibodies with characteristics desirable in the DVD-Ig molecule may be selected based on factors such as pharmacokinetic t ½; tissue distribution; soluble versus cell surface targets; and target concentration-soluble/density—surface.

B 8. In Vivo Tissue Distribution

To generate a DVD-Ig molecule with desired in vivo tissue distribution, in an embodiment parent mAbs with similar desired in vivo tissue distribution profile must be selected. Alternatively, based on the mechanism of the dual-specific targeting strategy, it may at other times not be required to select parent mAbs with the similarly desired in vivo tissue distribution when given in combination. For instance, in the case of a DVD-Ig in which one binding component targets the DVD-Ig to a specific site thereby bringing the second binding component to the same target site. For example, one binding specificity of a DVD-Ig could target pancreas (islet cells) and the other specificity could bring GLP1 to the pancreas to induce insulin.

B 9. Isotype:

To generate a DVD-Ig molecule with desired properties including, but not limited to, Isotype, Effector functions and the circulating half-life, in an embodiment parent mAbs with appropriate Fc-effector functions depending on the therapeutic utility and the desired therapeutic end-point are selected. There are five main heavy-chain classes or isotypes some of which have several sub-types and these determine the effector functions of an antibody molecule. These effector functions reside in the hinge region, CH2 and CH3 domains of the antibody molecule. However, residues in other parts of an antibody molecule may have effects on effector functions as well. The hinge region Fc-effector functions include: (i) antibody-dependent cellular cytotoxicity, (ii) complement (C1q) binding, activation and complement-dependent cytotoxicity (CDC), (iii) phagocytosis/clearance of antigen-antibody complexes, and (iv) cytokine release in some instances. These Fc-effector functions of an antibody molecule are mediated through the interaction of the Fc-region with a set of class-specific cell surface receptors. Antibodies of the IgG1 isotype are most active while IgG2 and IgG4 having minimal or no effector functions. The effector functions of the IgG antibodies are mediated through interactions with three structurally homologous cellular Fc receptor types (and sub-types) (FcgRI, FcgRII and FcgRIII). These effector functions of an IgG1 can be eliminated by mutating specific amino acid residues in the lower hinge region (e.g., L234A, L235A) that are required for FcgR and C1q binding Amino acid residues in the Fc region, in particular the CH2-CH3 domains, also determine the circulating half-life of the antibody molecule. This Fc function is mediated through the binding of the Fc-region to the neonatal Fc receptor (FcRn) which is responsible for recycling of antibody molecules from the acidic lysosomes back to the general circulation.

Whether a mAb should have an active or an inactive isotype will depend on the desired therapeutic end-point for an antibody. Some examples of usage of isotypes and desired therapeutic outcome are listed below:

a) If the desired end-point is functional neutralization of a soluble cytokine then an inactive isotype may be used;
b) If the desired out-come is clearance of a pathological protein an active isotype may be used;
c) If the desired out-come is clearance of protein aggregates an active isotype may be used;
d) If the desired outcome is to antagonize a surface receptor an inactive isotype is used (Tysabri, IgG4; OKT3, mutated IgG1);
e) If the desired outcome is to eliminate target cells an active isotype is used (Herceptin, IgG1 (and with enhanced effector functions); and
f) If the desired outcome is to clear proteins from circulation without entering the CNS an IgM isotype may be used (e.g., clearing circulating Ab peptide species).

The Fc effector functions of a parental mAb can be determined by various in vitro methods well known in the art.

As discussed, the selection of isotype, and thereby the effector functions will depend upon the desired therapeutic end-point. In cases where simple neutralization of a circulating target is desired, for example blocking receptor-ligand interactions, the effector functions may not be required. In such instances isotypes or mutations in the Fc-region of an antibody that eliminate effector functions are desirable. In other instances where elimination of target cells is the therapeutic end-point, for example elimination of tumor cells, isotypes or mutations or de-fucosylation in the Fc-region that enhance effector functions are desirable (Presta G L, Adv. Drug Delivery Rev. 58:640-656, 2006; Satoh M., Iida S., Shitara K. Expert Opinion Biol. Ther. 6:1161-1173, 2006). Similarly, depending up on the therapeutic utility, the circulating half-life of an antibody molecule can be reduced/prolonged by modulating antibody-FcRn interactions by introducing specific mutations in the Fc region (Dall'Acqua W F, Kiener P A, Wu H. J. Biol. Chem. 281:23514-23524, 2006; Petkova S B., Akilesh S., Sproule T J. et al. Internat. Immunol. 18:1759-1769, 2006; Vaccaro C., Bawdon R., Wanjie S et al. PNAS 103:18709-18714, 2007).

The published information on the various residues that influence the different effector functions of a normal therapeutic mAb may need to be confirmed for DVD-Ig. It may be possible that in a DVD-Ig format additional (different) Fc-region residues, other than those identified for the modulation of monoclonal antibody effector functions, may be important.

Overall, the decision as to which Fc-effector functions (isotype) will be critical in the final DVD-Ig format will depend up on the disease indication, therapeutic target, desired therapeutic end-point and safety considerations. Listed below are exemplary appropriate heavy chain and light chain constant regions including, but not limited to:

IgG1—allotype: G1mz
IgG1 mutant—A234, A235
IgG2—allotype: G2m(n−)
Kappa—Km3
Lambda Fc Receptor and C1q Studies: The possibility of unwanted antibody-dependent cell-mediated cytotoxicity (ADCC) and complement-dependent cytotoxicity (CDC) by antibody complexing to any overexpressed target on cell membranes can be abrogated by the (for example, L234A, L235A) hinge-region mutations. These substituted amino acids, present in the IgG1 hinge region of mAb, are expected to result in diminished binding of mAb to human Fc receptors (but not FcRn), as FcgR binding is thought to occur within overlapping sites on the IgG1 hinge region. This feature of mAb may lead to an improved safety profile over antibodies containing a wild-type IgG. Binding of mAb to human Fc receptors can be determined by flow cytometry experiments using cell lines (e.g., THP-1, K562) and an engineered CHO cell line that expresses FcgRIIb (or other FcgRs). Compared to IgG1 control monoclonal antibodies, mAb show reduced binding to FcgRI and FcgRIIa whereas binding to FcgRIIb is unaffected. The binding and activation of C1q by antigen/IgG immune complexes triggers the classical complement cascade with consequent inflammatory and/or immunoregulatory responses. The C1q binding site on IgGs has been localized to residues within the IgG hinge region. C1q binding to increasing concentrations of mAb was assessed by C1q ELISA. The results demonstrate that mAb is unable to bind to C1q, as expected when compared to the binding of a wildtype control IgG1. Overall, the L234A, L235A hinge region mutation abolishes binding of mAb to FcgRI, FcgRIIa and C1q but does not impact the interaction of mAb with FcgRIIb. This data suggests that in vivo, mAb with mutant Fc will interact normally with the inhibitory FcgRIIb but will likely fail to interact with the activating FcgRI and FcgRIIa receptors or C1q.

Human FcRn binding: The neonatal receptor (FcRn) is responsible for transport of IgG across the placenta and to control the catabolic half-life of the IgG molecules. It might be desirable to increase the terminal half-life of an antibody to improve efficacy, to reduce the dose or frequency of administration, or to improve localization to the target. Alternatively, it might be advantageous to do the converse that is, to decrease the terminal half-life of an antibody to reduce whole body exposure or to improve the target-to-non-target binding ratios. Tailoring the interaction between IgG and its salvage receptor, FcRn, offers a way to increase or decrease the terminal half-life of IgG. Proteins in the circulation, including IgG, are taken up in the fluid phase through micropinocytosis by certain cells, such as those of the vascular endothelia. IgG can bind FcRn in endosomes under slightly acidic conditions (pH 6.0-6.5) and can recycle to the cell surface, where it is released under almost neutral conditions (pH 7.0-7.4). Mapping of the Fc-region-binding site on FcRn80, 16, 17 showed that two histidine residues that are conserved across species, His310 and His435, are responsible for the pH dependence of this interaction. Using phage-display technology, a mouse Fc-region mutation that increases binding to FcRn and extends the half-life of mouse IgG was identified (see Victor, G. et al.; Nature Biotechnology (1997), 15(7), 637-640). Fc-region mutations that increase the binding affinity of human IgG for FcRn at pH 6.0, but not at pH 7.4, have also been identified (see Dall'Acqua William F, et al., Journal of Immunology (2002), 169(9), 5171-80). Moreover, in one case, a similar pH-dependent increase in binding (up to 27-fold) was also observed for rhesus FcRn, and this resulted in a twofold increase in serum half-life in rhesus monkeys compared with the parent IgG (see Hinton, Paul R. et al., Journal of Biological Chemistry (2004), 279(8), 6213-6216). These findings indicate that it is feasible to extend the plasma half-life of antibody therapeutics by tailoring the interaction of the Fc region with FcRn. Conversely, Fc-region mutations that attenuate interaction with FcRn can reduce antibody half-life.

B.10 Pharmacokinetics (PK):

To generate a DVD-Ig molecule with desired pharmacokinetic profile, in an embodiment parent mAbs with the similarly desired pharmacokinetic profile are selected. One consideration is that immunogenic response to monoclonal antibodies (i.e., HAHA, human anti-human antibody response; HACA, human anti-chimeric antibody response) further complicates the pharmacokinetics of these therapeutic agents. In an embodiment, monoclonal antibodies with minimal or no immunogenicity are used for constructing DVD-Ig molecules such that the resulting DVD-Igs will also have minimal or no immunogenicity. Some of the factors that determine the PK of a mAb include, but are not limited to, Intrinsic properties of the mAb (VH amino acid sequence); immunogenicity; FcRn binding and Fc functions.

The PK profile of selected parental monoclonal antibodies can be easily determined in rodents as the PK profile in rodents correlates well with (or closely predicts) the PK profile of monoclonal antibodies in cynomolgus monkey and humans. The PK profile is determined as described in Example section 1.2.2.3.A.

After the parental monoclonal antibodies with desired PK characteristics (and other desired functional properties as discussed herein) are selected, the DVD-Ig is constructed. As the DVD-Ig molecules contain two antigen-binding domains from two parental monoclonal antibodies, the PK properties of the DVD-Ig are assessed as well. Therefore, while determining the PK properties of the DVD-Ig, PK assays may be employed that determine the PK profile based on functionality of both antigen-binding domains derived from the 2 parent monoclonal antibodies. The PK profile of a DVD-Ig can be determined as described in Example 1.2.2.3.A. Additional factors that may impact the PK profile of DVD-Ig include the antigen-binding domain (CDR) orientation; Linker size; and Fc/FcRn interactions. PK characteristics of parent antibodies can be evaluated by assessing the following parameters: absorption, distribution, metabolism and excretion.

Absorption: To date, administration of therapeutic monoclonal antibodies is via parenteral routes (e.g., intravenous [IV], subcutaneous [SC], or intramuscular [IM]). Absorption of a mAb into the systemic circulation following either SC or IM administration from the interstitial space is primarily through the lymphatic pathway. Saturable, presystemic, proteolytic degradation may result in variable absolute bioavailability following extravascular administration. Usually, increases in absolute bioavailability with increasing doses of monoclonal antibodies may be observed due to saturated proteolytic capacity at higher doses. The absorption process for a mAb is usually quite slow as the lymph fluid drains slowly into the vascular system, and the duration of absorption may occur over hours to several days. The absolute bioavailability of monoclonal antibodies following SC administration generally ranges from 50% to 100%.

Distribution: Following IV administration, monoclonal antibodies usually follow a biphasic serum (or plasma) concentration-time profile, beginning with a rapid distribution phase, followed by a slow elimination phase. In general, a biexponential pharmacokinetic model best describes this kind of pharmacokinetic profile. The volume of distribution in the central compartment (Vc) for a mAb is usually equal to or slightly larger than the plasma volume (2-3 liters). A distinct biphasic pattern in serum (plasma) concentration versus time profile may not be apparent with other parenteral routes of administration, such as IM or SC, because the distribution phase of the serum (plasma) concentration-time curve is masked by the long absorption portion. Many factors, including physicochemical properties, site-specific and target-oriented receptor mediated uptake, binding capacity of tissue, and mAb dose can influence biodistribution of a mAb. Some of these factors can contribute to nonlinearity in biodistribution for a mAb.

Metabolism and Excretion: Due to the molecular size, intact monoclonal antibodies are not excreted into the urine via kidney. They are primarily inactivated by metabolism (e.g., catabolism). For IgG-based therapeutic monoclonal antibodies, half-lives typically ranges from hours or 1-2 days to over 20 days. The elimination of a mAb can be affected by many factors, including, but not limited to, affinity for the FcRn receptor, immunogenicity of the mAb, the degree of glycosylation of the mAb, the susceptibility for the mAb to proteolysis, and receptor-mediated elimination.

B.11 Tissue Cross-Reactivity Pattern on Human and Tox Species:

Identical staining pattern suggests that potential human toxicity can be evaluated in tox species. Tox species are those animal in which unrelated toxicity is studied.

The individual antibodies are selected to meet two criteria. (1) Tissue staining appropriate for the known expression of the antibody target. (2) Similar staining pattern between human and tox species tissues from the same organ.

Criterion 1: Immunizations and/or antibody selections typically employ recombinant or synthesized antigens (proteins, carbohydrates or other molecules). Binding to the natural counterpart and counterscreen against unrelated antigens are often part of the screening funnel for therapeutic antibodies. However, screening against a multitude of antigens is often unpractical. Therefore tissue cross-reactivity studies with human tissues from all major organs serve to rule out unwanted binding of the antibody to any unrelated antigens.

Criterion 2: Comparative tissue cross reactivity studies with human and tox species tissues (cynomolgus monkey, dog, possibly rodents and others, the same 36 or 37 tissues are being tested as in the human study) help to validate the selection of a tox species. In the typical tissue cross-reactivity studies on frozen tissues sections therapeutic antibodies may demonstrate the expected binding to the known antigen and/or to a lesser degree binding to tissues based either on low level interactions (unspecific binding, low level binding to similar antigens, low level charge based interactions etc.). In any case the most relevant toxicology animal species is the one with the highest degree of coincidence of binding to human and animal tissue.

Tissue cross reactivity studies follow the appropriate regulatory guidelines including EC CPMP Guideline III/5271/94 "Production and quality control of mAbs" and the 1997 US FDA/CBER "Points to Consider in the Manufacture and Testing of Monoclonal Antibody Products for Human Use". Cryosections (5 μm) of human tissues obtained at autopsy or biopsy were fixed and dried on object glass. The peroxidase staining of tissue sections was performed, using the avidin-biotin system. FDA's Guidance *"Points to Consider in the Manufacture and Testing of Monoclonal Antibody Products for Human Use"*. Relevant references include Clarke J 2004, Boon L. 2002a, Boon L 2002b, Ryan A 1999.

Tissue cross reactivity studies are often done in two stages, with the first stage including cryosections of 32 tissues (typically: Adrenal Gland, Gastrointestinal Tract, Prostate, Bladder, Heart, Skeletal Muscle, Blood Cells, Kidney, Skin, Bone Marrow, Liver, Spinal Cord, Breast, Lung, Spleen, Cerebellum, Lymph Node, Testes, Cerebral Cortex, Ovary, Thymus, Colon, Pancreas, Thyroid, Endothelium, Parathyroid, Ureter, Eye, Pituitary, Uterus, Fallopian Tube and Placenta) from one human donor. In the second phase a full cross reactivity study is performed with up to 38 tissues (including adrenal, blood, blood vessel, bone marrow, cerebellum, cerebrum, cervix, esophagus, eye, heart, kidney, large intestine, liver, lung, lymph node, breast mammary gland, ovary, oviduct, pancreas, parathyroid, peripheral nerve, pituitary, placenta, prostate, salivary gland, skin, small intestine, spinal cord, spleen, stomach, striated muscle, testis, thymus, thyroid, tonsil, ureter, urinary bladder, and uterus) from 3 unrelated adults. Studies are done typically at minimally two dose levels.

The therapeutic antibody (i.e. test article) and isotype matched control antibody may be biotinylated for avidin-biotin complex (ABC) detection; other detection methods may include tertiary antibody detection for a FITC (or otherwise) labeled test article, or precomplexing with a labeled anti-human IgG for an unlabeled test article.

Briefly, cryosections (about 5 μm) of human tissues obtained at autopsy or biopsy are fixed and dried on object glass. The peroxidase staining of tissue sections is performed, using the avidin-biotin system. First (in case of a precomplexing detection system), the test article is incubated with the secondary biotinylated anti-human IgG and developed into immune complex. The immune complex at the final concentrations of 2 and 10 μg/mL of test article is added onto tissue sections on object glass and then the tissue sections were reacted for 30 minutes with a avidin-biotin-peroxidase kit. Subsequently, DAB (3,3'-diaminobenzidine), a substrate for the peroxidase reaction, was applied for 4 minutes for tissue staining. Antigen-Sepharose beads are used as positive control tissue sections.

Any specific staining is judged to be either an expected (e.g., consistent with antigen expression) or unexpected reactivity based upon known expression of the target antigen in question. Any staining judged specific is scored for intensity and frequency. Antigen or serum completion or blocking studies can assist further in determining whether observed staining is specific or nonspecific.

If two selected antibodies are found to meet the selection criteria appropriate tissue staining, matching staining between human and toxicology animal specific tissue they can be selected for DVD-Ig generation.

The tissue cross reactivity study has to be repeated with the final DVD-Ig construct, but while these studies follow the same protocol as outline herein, they are more complex to evaluate because any binding can come from any of the two parent antibodies, and any unexplained binding needs to be confirmed with complex antigen competition studies.

It is readily apparent that the complex undertaking of tissue crossreactivity studies with a multispecific molecule like a DVD-Ig is greatly simplified if the two parental antibodies are selected for (1) lack of unexpected tissue cross reactivity findings and (2) for appropriate similarity of tissue cross reactivity findings between the corresponding human and toxicology animal species tissues.

B.12 Specificity and Selectivity:

To generate a DVD-Ig molecule with desired specificity and selectivity, one needs to generate and select parent mAbs with the similarly desired specificity and selectivity profile.

Binding studies for specificity and selectivity with a DVD-Ig can be complex due to the four or more binding sites, two each for each antigen. Briefly, binding studies using ELISA, BIAcore. KinExA or other interaction studies with a DVD-Ig need to monitor the binding of one, two or more antigens to the DVD-Ig molecule. While BIAcore technology can resolve the sequential, independent binding of multiple antigens, more traditional methods including ELISA or more modern techniques like KinExA cannot. Therefore careful characterization of each parent antibody is critical. After each individual antibody has been characterized for specificity, confirmation of specificity retention of the individual binding sites in the DVD-Ig molecule is greatly simplified.

It is readily apparent that the complex undertaking of determining the specificity of a DVD-Ig is greatly simplified if the two parental antibodies are selected for specificity prior to being combined into a DVD-Ig.

Antigen-antibody interaction studies can take many forms, including many classical protein protein interaction studies, including ELISA (Enzyme linked immunosorbent assay), Mass spectrometry, chemical cross linking, SEC with light scattering, equilibrium dialysis, gel permeation, ultrafiltration, gel chromatography, large-zone analytical SEC, micropreparative ultracentrigugation (sedimentation equilibrium), spectroscopic methods, titration microcalorimetry, sedimentation equilibrium (in analytical ultracentrifuge), sedimentation velocity (in analytical centrifuge), surface plasmon resonance (including BIAcore). Relevant references include "Current Protocols in Protein Science", John E. Coligan, Ben M. Dunn, David W. Speicher, Paul T, Wingfield (eds.) Volume 3, chapters 19 and 20, published by John Wiley & Sons Inc., and references included therein and "Current Protocols in Immunology", John E. Coligan, Barbara E. Bierer, David H. Margulies, Ethan M. Shevach, Warren Strober (eds.) published by John Wiley & Sons Inc and relevant references included therein.

Cytokine Release in Whole Blood: The interaction of mAb with human blood cells can be investigated by a cytokine release assay (Wing, M. G. Therapeutic Immunology (1995), 2(4), 183-190; "Current Protocols in Pharmacology", S. J. Enna, Michael Williams, John W. Ferkany, Terry Kenakin, Paul Moser, (eds.) published by John Wiley & Sons Inc; Madhusudan, S. Clinical Cancer Research (2004), 10(19), 6528-6534; Cox, J. Methods (2006), 38(4), 274-282; Choi, I. European Journal of Immunology (2001), 31(1), 94-106). Briefly, various concentrations of mAb are incubated with human whole blood for 24 hours. The concentration tested should cover a wide range including final concentrations mimicking typical blood levels in patients (including but not limited to 100 ng/ml-100 μg/ml). Following the incubation, supernatants and cell lysates were analyzed for the presence of IL-1Rα, TNF-α, IL-1b, IL-6 and IL-8. Cytokine concentration profiles generated for mAb were compared to profiles produced by a negative human IgG control and a positive LPS or PHA control. The cytokine profile displayed by mAb from both cell supernatants and cell lysates was comparable to control human IgG. In an embodiment, the monoclonal antibody does not interact with human blood cells to spontaneously release inflammatory cytokines.

Cytokine release studies for a DVD-Ig are complex due to the four or more binding sites, two each for each antigen. Briefly, cytokine release studies as described herein measure the effect of the whole DVD-Ig molecule on whole blood or other cell systems, but can resolve which portion of the molecule causes cytokine release. Once cytokine release has been detected, the purity of the DVD-Ig preparation has to be ascertained, because some co-purifying cellular components can cause cytokine release on their own. If purity is not the issue, fragmentation of DVD-Ig (including but not limited to removal of Fc portion, separation of binding sites etc.), binding site mutagenesis or other methods may need to be employed to deconvolute any observations. It is readily apparent that this complex undertaking is greatly simplified if the two parental antibodies are selected for lack of cytokine release prior to being combined into a DVD-Ig.

B.13 Cross Reactivity to Other Species for Toxicological Studies:

In an embodiment, the individual antibodies selected with sufficient cross-reactivity to appropriate tox species, for example, cynomolgus monkey. Parental antibodies need to bind to orthologous species target (i.e. cynomolgus monkey) and elicit appropriate response (modulation, neutralization, activation). In an embodiment, the cross-reactivity (affinity/potency) to orthologous species target should be within 10-fold of the human target. In practice, the parental antibodies are evaluated for multiple species, including mouse, rat, dog, monkey (and other non-human primates), as well as disease model species (i.e. sheep for asthma model). The acceptable cross-reactivity to tox species from the perantal monoclonal antibodies allows future toxicology studies of DVD-Ig-Ig in the same species. For that reason, the two parental monoclonal antibodies should have acceptable cross-reactivity for a common tox species therefore allowing toxicology studies of DVD-Ig in the same species.

Parent mAbs may be selected from various mAbs capable of binding specific targets and well known in the art. These include, but are not limited to anti-TNF antibody (U.S. Pat. No. 6,258,562), anti-IL-12 and/or anti-IL-12p40 antibody (U.S. Pat. No. 6,914,128); anti-IL-18 antibody (US 2005/0147610 A1), anti-05, anti-CBL, anti-CD147, anti-gp120, anti-VLA-4, anti-CD11a, anti-CD18, anti-VEGF, anti-CD40L, anti-CD-40 (e.g., see WO2007124299) anti-Id, anti-ICAM-1, anti-CXCL13, anti-CD2, anti-EGFR, anti-TGF-beta 2, anti-HGF, anti-cMet, anti DLL-4, anti-NPR1, anti-PLGF, anti-ErbB3, anti-E-selectin, anti-Fact VII, anti-Her2/neu, anti-F gp, anti-CD11/18, anti-CD14, anti-ICAM-3, anti-RON, anti CD-19, anti-CD80 (e.g., see WO2003039486, anti-CD4, anti-CD3, anti-CD23, anti-beta2-integrin, anti-alpha4beta7, anti-CD52, anti-HLA DR, anti-CD22 (e.g., see U.S. Pat. No. 5,789,554), anti-CD20, anti-MIF, anti-CD64 (FcR), anti-TCR alpha beta, anti-CD2, anti-Hep B, anti-CA 125, anti-EpCAM, anti-gp120, anti-CMV, anti-gpIIbIIIa, anti-IgE, anti-CD25, anti-CD33, anti-HLA, anti-IGF1,2, anti-IGFR, anti-VNRintegrin, anti-IL-1alpha, anti-IL-1 beta, anti-IL-1 receptor, anti-IL-2 receptor, anti-IL-4, anti-IL-4 receptor, anti-IL-5, anti-IL-5 receptor, anti-IL-6, anti-IL-8, anti-IL-9, anti-IL-13, anti-IL-13 receptor, anti-IL-17, and anti-IL-23 (see Presta L G., 2005, Selection, design, and engineering of therapeutic antibodies, J. Allergy Clin. Immunol. 116:731-6.

Parent mAbs may also be selected from various therapeutic antibodies approved for use, in clinical trials, or in development for clinical use. Such therapeutic antibodies include, but are not limited to, rituximab (Rituxan®, IDEC/Genentech/Roche) (see for example U.S. Pat. No. 5,736,137), a chimeric anti-CD20 antibody approved to treat Non-Hodgkin's lymphoma; HuMax-CD20, an anti-CD20 currently being developed by Genmab, an anti-CD20 antibody described in U.S. Pat. No. 5,500,362, AME-133 (Applied Molecular Evolution), hA20 (Immunomedics, Inc.), HumaLYM (Intracel), and PRO70769 (PCT/US2003/040426, entitled "Immunoglobulin Variants and Uses Thereof"), trastuzumab (Herceptin®, Genentech) (see for example U.S. Pat. No. 5,677,171), a humanized anti-Her2/neu antibody approved to treat breast cancer; pertuzumab (rhuMab-2C4, Omnitarg®), currently being developed by Genentech; an anti-Her2 antibody described in U.S. Pat. No. 4,753,894; cetuximab (Erbitux®, Imclone) (U.S. Pat. No. 4,943,533; PCT WO 96/40210), a chimeric anti-EGFR antibody in clinical trials for a variety of cancers; ABX-EGF (U.S. Pat. No. 6,235,883), currently being developed by Abgenix-Immunex-Amgen; HuMax-EGFr (U.S. Ser. No. 10/172,317), currently being developed by Genmab; 425, EMD55900, EMD62000, and EMD72000 (Merck KGaA) (U.S. Pat. No. 5,558,864; Murthy et al. 1987, Arch Biochem Biophys. 252(2):549-60; Rodeck et al., 1987, J Cell Biochem. 35(4):315-20; Kettleborough et al., 1991, Protein Eng. 4(7):773-83); ICR62 (Institute of Cancer Research) (PCT WO 95/20045; Modjtahedi et al., 1993, J. Cell Biophys. 1993, 22(1-3):129-46; Modjtahedi et al., 1993, Br J. Cancer. 1993, 67(2):247-53; Modjtahedi et al, 1996, Br J Cancer, 73(2):228-35; Modjtahedi et al, 2003, Int J Cancer, 105(2):273-80); TheraCIM hR3 (YM Biosciences, Canada and Centro de Immunologia Molecular, Cuba (U.S. Pat. No. 5,891,996; U.S. Pat. No. 6,506,883; Mateo et al, 1997, Immunotechnology, 3(1):71-81); mAb-806 (Ludwig Institute for Cancer Research, Memorial Sloan-Kettering) (Jungbluth et al. 2003, Proc Natl Acad Sci USA. 100(2):639-44); KSB-102 (KS Biomedix); MR1-1 (IVAX, National Cancer Institute) (PCT WO 0162931A2); and SC100 (Scancell) (PCT WO 01/88138); alemtuzumab (Campath®, Millenium), a humanized mAb currently approved for treatment of B-cell chronic lymphocytic leukemia; muromonab-CD3 (Orthoclone OKT3®), an anti-CD3 antibody developed by Ortho Biotech/Johnson & Johnson, ibritumomab tiuxetan (Zevalin®), an anti-CD20 antibody developed by IDEC/Schering AG, gemtuzumab ozogamicin (Mylotarg®), an anti-CD33 (p67 protein) antibody developed by Celltech/Wyeth, alefacept (Amevive®), an anti-LFA-3 Fc fusion developed by Biogen), abciximab (ReoPro®), developed by Centocor/Lilly, basiliximab (Simulect®), developed by Novartis, palivizumab (Synagis®), developed by Medimmune, infliximab (Remicade®), an anti-TNFalpha antibody developed by Centocor, adalimumab (Humira®), an anti-TNFalpha antibody developed by Abbott, Humicade®, an anti-TNFalpha antibody developed by Celltech, golimumab (CNTO-148), a fully human TNF antibody developed by Centocor, etanercept (Enbrel®), an p75 TNF receptor Fc fusion developed by Immunex/Amgen, lenercept, an p55TNF receptor Fc fusion previously developed by Roche, ABX-CBL, an anti-CD147 antibody being developed by Abgenix, ABX-IL8, an anti-IL8 antibody being developed by Abgenix, ABX-MA1, an anti-MUC18 antibody being developed by Abgenix, Pemtumomab (R1549, 90Y-muHMFG1), an anti-MUC1 in development by Antisoma, Therex (R1550), an anti-MUC1 antibody being developed by Antisoma, AngioMab (AS1405), being developed by Antisoma, HuBC-1, being developed by Antisoma, Thioplatin (AS1407) being developed by Antisoma, Antegren® (natalizumab), an anti-alpha-4-beta-1 (VLA-4) and alpha-4-beta-7 antibody being developed by Biogen, VLA-1 mAb, an anti-VLA-1 integrin antibody being developed by Biogen, LTBR mAb, an anti-lymphotoxin beta receptor (LTBR) antibody being developed by Biogen, CAT-152, an anti-TGF-β2 antibody being developed by Cambridge Antibody Technology, ABT 874 (J695), an anti-IL-12 p40 antibody being developed by Abbott, CAT-192, an anti-TGFβ1 antibody being developed by Cambridge Antibody Technology and Genzyme, CAT-213, an anti-Eotaxin1 antibody being developed by Cambridge Antibody Technology, LymphoStat-B® an anti-Blys antibody being developed by Cambridge Antibody Technology and Human Genome Sciences Inc., TRAIL-R1 mAb, an anti-TRAIL-R1 antibody being developed by Cambridge Antibody Technology and Human Genome Sciences, Inc., Avastin® bevacizumab, rhuMAb-VEGF), an anti-VEGF antibody being developed by Genentech, an anti-HER receptor family antibody being developed by Genentech, Anti-Tissue Factor (ATF), an anti-Tissue Factor antibody being developed by Genentech, Xolair® (Omalizumab), an anti-IgE antibody being developed by Genentech, Raptiva® (Efalizumab), an anti-CD11a antibody being developed by Genentech and Xoma, MLN-02 Antibody (formerly LDP-02), being developed by Genentech and Millenium Pharmaceuticals, HuMax CD4, an anti-CD4 antibody being developed by Genmab, HuMax-IL15, an anti-IL15 antibody being developed by Genmab and Amgen, HuMax-Inflam, being developed by Genmab and Medarex, HuMax-Cancer, an anti-Heparanase I antibody being developed by Genmab and Medarex and Oxford GcoSciences, HuMax-Lymphoma, being developed by Genmab and Amgen, HuMax-TAC, being developed by Genmab, IDEC-131, and anti-CD40L antibody being developed by IDEC Pharmaceuticals, IDEC-151 (Clenoliximab), an anti-CD4 antibody being developed by IDEC Pharmaceuticals, IDEC-114, an anti-CD80 antibody being developed by IDEC Pharmaceuticals, IDEC-152, an anti-CD23 being developed by IDEC Pharmaceuticals, anti-macrophage migration factor (MIF) antibodies being developed by IDEC Pharmaceuticals, BEC2, an anti-idiotypic antibody being developed by Imclone, IMC-1C11, an anti-KDR antibody being developed by Imclone, DC101, an anti-flk-1 antibody being developed by Imclone, anti-VE cadherin antibodies being developed by Imclone, CEA-Cide® (labetuzumab), an anti-carcinoembryonic antigen (CEA) antibody being developed by Immunomedics, LymphoCide® (Epratuzumab), an anti-CD22 antibody being developed by Immunomedics, AFP-Cide, being developed by Immunomedics, MyelomaCide, being developed by Immunomedics, LkoCide, being developed by Immunomedics, ProstaCide, being developed by Immunomedics, MDX-010, an anti-CTLA4 antibody being developed by Medarex, MDX-060, an anti-CD30 antibody being developed by Medarex, MDX-070 being developed by Medarex, MDX-018 being developed by Medarex, Osidem® (IDM-1), and anti-Her2 antibody being developed by Medarex and Immuno-Designed Molecules, HuMax®-CD4, an anti-CD4 antibody being developed by Medarex and Genmab, HuMax-IL15, an anti-IL15 antibody being developed by Medarex and Genmab, CNTO 148, an anti-TNFα antibody being developed by Medarex and Centocor/J&J, CNTO 1275, an anti-cytokine antibody being developed by Centocor/J&J, MOR101 and MOR102, anti-intercellular adhesion molecule-1 (ICAM-1) (CD54) antibodies being developed by MorphoSys, MOR201, an anti-fibroblast growth factor receptor 3 (FGFR-3) antibody being developed by MorphoSys, Nuvion® (visilizumab), an anti-CD3 antibody being developed by Protein Design Labs, HuZAF®, an anti-gamma interferon antibody being developed by Protein Design Labs, Anti-α 5β1 Integrin, being developed by Protein Design Labs, anti-IL-12, being developed by Protein Design Labs, ING-1, an anti-Ep-CAM antibody being developed by Xoma, Xolair® (Omalizumab) a humanized anti-IgE antibody developed by Genentech and Novartis, and MLN01, an anti-Beta2 integrin antibody being developed by Xoma, all of the herein-cited references in this paragraph are expressly incorporated herein by reference. In another embodiment, the therapeutics include KRN330 (Kirin); huA33 antibody (A33, Ludwig Institute for Cancer Research); CNTO 95 (alpha V integrins, Centocor); MEDI-522 (alpha Vβ3 integrin, Medimmune); volociximab (alpha Vβ1 integrin, Biogen/PDL); Human mAb 216 (B cell glycosolated epitope, NCI); BiTE MT103 (bispecific CD19×CD3, Medimmune); 4G7×H22 (Bispecific BcellxFcgammaR1, Medarex/Merck KGa); rM28 (Bispecific CD28×MAPG, US Pat. No. EP1,444,268); MDX447 (EMD 82633) (Bispecific CD64×EGFR, Medarex); Catumaxomab (removab) (Bispecific EpCAM× anti-CD3, Trion/Fres); Ertumaxomab (bispecific HER2/CD3, Fresenius Biotech); oregovomab (OvaRex) (CA-125, ViRexx); Rencarex® (WX G250) (carbonic anhydrase IX, Wilex); CNTO 888 (CCL2, Centocor); TRC105 (CD105 (endoglin), Tracon); BMS-663513 (CD137 agonist, Brystol Myers Squibb); MDX-1342 (CD19, Medarex); Siplizumab (MEDI-507) (CD2, Medimmune); Ofatumumab (Humax-CD20) (CD20, Genmab); Rituximab (Rituxan) (CD20, Genentech); veltuzumab (hA20) (CD20, Immunomedics); Epratuzumab (CD22, Amgen); lumiliximab (IDEC 152) (CD23, Biogen); muromonab-CD3 (CD3, Ortho); HuM291 (CD3 fc receptor, PDL Biopharma); HeFi-1, CD30, NCI); MDX-060 (CD30, Medarex); MDX-1401 (CD30, Medarex); SGN-30 (CD30, Seattle Genentics); SGN-33 (Lintuzumab) (CD33, Seattle Genentics); Zanolimumab (HuMax-CD4) (CD4, Genmab); HCD122 (CD40, Novartis); SGN-40 (CD40, Seattle Genentics); Campath1h (Alemtuzumab) (CD52, Genzyme); MDX-1411 (CD70, Medarex); hLL1 (EPB-1) (CD74.38, Immunomedics); Galiximab (IDEC-144) (CD80, Biogen); MT293 (TRC093/D93) (cleaved collagen, Tracon); HuLuc63 (CS1, PDL Pharma); ipilimumab (MDX-010) (CTLA4, Brystol Myers Squibb); Tremelimumab (Ticilimumab, CP-675,2) (CTLA4, Pfizer); HGS-ETR1 (Mapatumumab) (DR4 TRAIL-R1 agonist, Human Genome Science/Glaxo Smith Kline); AMG-655 (DR5, Amgen); Apomab (DR5, Genentech); CS-1008 (DR5, Daiichi Sankyo); HGS-ETR2 (lexatumumab) (DR5 TRAIL-R2 agonist, HGS); Cetuximab (Erbitux) (EGFR, Imclone); IMC-11F8, (EGFR, Imclone); Nimotuzumab (EGFR, YM Bio); Panitumumab (Vectabix) (EGFR, Amgen); Zalutumumab (HuMaxEGFr) (EGFR, Genmab); CDX-110 (EGFRvIII, AVANT Immunotherapeutics); adecatumumab (MT201) (Epcam, Merck); edrecolomab (Panorex, 17-1A) (Epcam, Glaxo/Centocor); MORAb-003 (folate receptor a, Morphotech); KW-2871 (ganglioside GD3, Kyowa); MORAb-009 (GP-9, Morphotech); CDX-1307 (MDX-1307) (hCGb, Celldex); Trastuzumab (Herceptin) (HER2, Celldex); Pertuzumab (rhuMAb 2C4) (HER2 (DI), Genentech); apolizumab (HLA-DR beta chain, PDL Pharma); AMG-479 (IGF-1R, Amgen); anti-IGF-1R R1507 (IGF1-R, Roche); CP 751871 (IGF1-R, Pfizer); IMC-A12 (IGF-1R, Imclone); BIIB022 (IGF-1R, Biogen); Mik-beta-1 (IL-2Rb (CD122), Hoffman LaRoche); CNTO 328 (IL6, Centocor); Anti-KIR (1-7F9) (Killer cell Ig-like Receptor (KIR), Novo); Hu3S193 (Lewis (y), Wyeth, Ludwig Institute of Cancer Research); hCBE-11 (LTβR, Biogen); HuHMFG1 (MUC1, Antisoma/NCI); RAV12 (N-linked carbohydrate epitope, Raven); CAL (parathyroid hormone-related protein (PTH-rP), University of California); CT-011 (PD1, CureTech); MDX-1106 (ono-4538) (PD1, Medarex/Ono); MAb CT-011 (PD1, Curetech); IMC-3G3 (PDGFRa, Imclone); bavituximab (phosphatidylserine, Peregrine); huJ591 (PSMA, Cornell Research Foundation); muJ591 (PSMA, Cornell Research Foundation); GC1008 (TGFb (pan) inhibitor (IgG4), Genzyme); Infliximab (Remicade) (TNFa, Centocor); A27.15 (transferrin receptor, Salk Institute, INSERN WO 2005/111082); E2.3 (transferrin receptor, Salk Institute); Bevacizumab (Avastin) (VEGF, Genentech); HuMV833 (VEGF, Tsukuba Research Lab-WO/2000/034337, University of Texas); IMC-18F1 (VEGFR1, Imclone); IMC-1121 (VEGFR2, Imclone).

B. Construction of DVD Molecules:

The dual variable domain immunoglobulin (DVD-Ig) molecule is designed such that two different light chain variable domains (VL) from the two different parent monoclonal antibodies are linked in tandem directly or via a short linker by recombinant DNA techniques, followed by the light chain constant domain. Similarly, the heavy chain comprises two different heavy chain variable domains (VH) linked in tandem, followed by the constant domain CH1 and Fc region (FIG. 1A).

The variable domains can be obtained using recombinant DNA techniques from a parent antibody generated by any one of the methods described herein. In an embodiment, the variable domain is a murine heavy or light chain variable domain. In another embodiment, the variable domain is a CDR grafted or a humanized variable heavy or light chain domain. In an embodiment, the variable domain is a human heavy or light chain variable domain.

In one embodiment the first and second variable domains are linked directly to each other using recombinant DNA techniques. In another embodiment the variable domains are linked via a linker sequence. In an embodiment, two variable domains are linked. Three or more variable domains may also be linked directly or via a linker sequence. The variable domains may bind the same antigen or may bind different antigens. DVD molecules of the invention may include one immunoglobulin variable domain and one non-immunoglobulin variable domain such as ligand binding domain of a receptor, active domain of an enzyme. DVD molecules may also comprise 2 or more non-Ig domains.

The linker sequence may be a single amino acid or a polypeptide sequence. In an embodiment, the linker sequences are selected from the group consisting of AKTTPKLEEGEFSEAR (SEQ ID NO: 1); AKTTPKLEEGEFSEARV (SEQ ID NO: 2); AKTTPKLGG (SEQ ID NO: 3); SAKTTPKLGG (SEQ ID NO: 4); SAKTTP (SEQ ID NO: 5); RADAAP (SEQ ID NO: 6); RADAAPTVS (SEQ ID NO: 7); RADAAAAGGPGS (SEQ ID NO: 8); RADAAAA($G_4S$)$_4$ (SEQ ID NO: 9); SAKTTPKLEEGEFSEARV (SEQ ID NO: 10); ADAAP (SEQ ID NO: 11); ADAAPTVSIFPP (SEQ ID NO: 12); TVAAP (SEQ ID NO: 13); TVAAPSVFIFPP (SEQ ID NO: 14); QPKAAP (SEQ ID NO: 15); QPKAAPSVTLFPP (SEQ ID NO: 16); AKTTPP (SEQ ID NO: 17); AKTTPPSVTPLAP (SEQ ID NO: 18); AKTTAP (SEQ ID NO: 19); AKTTAPSVYPLAP (SEQ ID NO: 20); ASTKGP (SEQ ID NO: 21); ASTKGPSVFPLAP (SEQ ID NO: 22); GGGGSGGGGSGGGGS (SEQ ID NO: 23); GENKVEYAPALMALS (SEQ ID NO: 24); GPAKELTPLKEAKVS (SEQ ID NO: 25); GHEAAAVMQVQYPAS (SEQ ID NO: 26). The choice of linker sequences is based on crystal structure analysis of several Fab molecules. There is a natural flexible linkage between the variable domain and the CH1/CL constant domain in Fab or antibody molecular structure. This natural linkage comprises approximately 10-12 amino acid residues, contributed by 4-6 residues from C-terminus of V domain and 4-6 residues from the N-terminus of CL/CH1 domain. DVD Igs of the invention were generated using N-terminal 5-6 amino acid residues, or 11-12 amino acid residues, of CL or CH1 as linker in light chain and heavy chain of DVD-Ig, respectively. The N-terminal residues of CL or CH1 domains, particularly the first 5-6 amino acid residues, adopt a loop conformation without strong secondary structures, therefore can act as flexible linkers between the two variable domains. The N-terminal residues of CL or CH1 domains are natural extension of the variable domains, as they are part of the Ig sequences, therefore minimize to a large extent any immunogenicity potentially arising from the linkers and junctions.

Other linker sequences may include any sequence of any length of CL/CH1 domain but not all residues of CL/CH1 domain; for example the first 5-12 amino acid residues of the CL/CH1 domains; the light chain linkers can be from Cκ or Cλ; and the heavy chain linkers can be derived from CH1 of any isotypes, including Cγ1, Cγ2, Cγ3, Cγ4, Cα1, Cα2, Cδ, Cε, and Cμ. Linker sequences may also be derived from other proteins such as Ig-like proteins, (e.g. TCR, FcR, KIR); G/S based sequences (e.g. G4S repeats); hinge region-derived sequences; and other natural sequences from other proteins.

In an embodiment a constant domain is linked to the two linked variable domains using recombinant DNA techniques. In an embodiment, sequence comprising linked heavy chain variable domains is linked to a heavy chain constant domain and sequence comprising linked light chain variable domains is linked to a light chain constant domain. In an embodiment, the constant domains are human heavy chain constant domain and human light chain constant domain respectively. In an embodiment, the DVD heavy chain is further linked to an Fc region. The Fc region may be a native sequence Fc region, or a variant Fc region. In another embodiment, the Fc region is a human Fc region. In another embodiment the Fc region includes Fc region from IgG1, IgG2, IgG3, IgG4, IgA, IgM, IgE, or IgD.

In another embodiment two heavy chain DVD polypeptides and two light chain DVD polypeptides are combined to form a DVD-Ig molecule. Table 2 lists amino acid sequences of VH and VL regions of exemplary antibodies for targets useful for treating disease, e.g., for treating cancer. In an embodiment, the invention provides a DVD comprising at least two of the VH and/or VL regions listed in Table 2, in any orientation.

TABLE 2

List of Amino Acid Sequences of VH and VL regions of Antibodies for Generating DVD-Igs

| SEQ ID No. | ABT Unique ID | Protein region | Sequence 12345678901234567890123456789012345678901234567890 |
|---|---|---|---|
| 27 | AB001VH | VH CD20 | QVQLQQPGAELVKPGASVKMSCKASGYTFTSYNMHWVKQT PGRGLEWIGAIYPGNGDTSYNQKFKGKATLTADKSSSTAY MQLSSLTSEDSAVYYCARSTYYGGDWYFNVWGAGTTVTVSA |
| 28 | AB001VL | VL CD20 | QIVLSQSPAILSPSPGEKVTMTCRASSSVSYIHWFQQKPG SSPKPWIYATSNLASGVPVRFSGSGSGTSYSLTISRVEAE DAATYYCQQWTSNPPTFGGGTKLEIKR |
| 29 | AB002VH | VH CD3 (seq. 1) | QVQLQQSGAELARPGASVKMSCKASGYTFTRYTMHWVKQR PGQGLEWIGYINPSRGYTNYNQKFKDKATLTTDKSSSTAY MQLSSLTSEDSAVYYCARYYDDHYCLDYWGQGTTLTVSS |
| 30 | AB002VL | VL CD3 (seq. 1) | QIVLTQSPAIMSASPGEKVTMTCRASSSVSYMNWYQQKSG TSPKRWIYDTSKVASGVPYRFSGSGSGTSYSLTISSMEAE DAATYYCQQWSSNPLTFGSGTKLEINR |
| 31 | AB003VH | VH EGFR (seq. 1) | QVQLQESGPGLVKPSETLSLTCTVSGGSVSSGDYYWTWIR QSPGKGLEWIGHIYYSGNTNYNPSLKSRLTISIDTSKTQF SLKLSSVTAADTAIYYCVRDRVTGAFDIWGQGTMVTVSS |
| 32 | AB003VL | VL EGFR (seq. 1) | DIQMTQSPSSLSASVGDRVTITCQASQDISNYLNWYQQKP GKAPKLLIYDASNLETGVPSRFSGSGSGTDFTFTISSLQP EDIATYFCQHFDHLPLAFGGGTKVEIKR |

TABLE 2-continued

List of Amino Acid Sequences of VH and VL regions of
Antibodies for Generating DVD-Igs

| SEQ ID No. | ABT Unique ID | Protein region | Sequence 12345678901234567890123456789012345678901234567890 |
|---|---|---|---|
| 33 | AB004VH | VH HER2 (seq. 1) | EVQLVESGGGLVQPGGSLRLSCAASGFNIKDTYIHWVRQA PGKGLEWVARIYPTNGYTRYADSVKGRFTISADTSKNTAY LQMNSLRAEDTAVYYCSRWGGDGFYAMDYWGQGTLVTVSS |
| 34 | AB004VL | VL HER2 (seq. 1) | DIQMTQSPSSLSASVGDRVTITCRASQDVNTAVAWYQQKP GKAPKLLIYSASFLYSGVPSRFSGSRSGTDFTLTISSLQP EDFATYYCQQHYTTPPTFGQGTKVEIKR |
| 35 | AB005VH | VH RON (seq. 1) | EVQLVQSGGGLVKPGGSLRLSCAASGFTFSSYAMHWVRQA PGKGLEWVAVISYDGSNKYYADSVKGRFTISRDNSKNTLY LQMNSLRAEDTAVYYCARFSGWPNNYYYYGMDVWGQGTTV TVSS |
| 36 | AB005VL | VL RON (seq. 1) | DVVMTQSPLSLPVTPGEPASISCRSSQSLLHSNGFNYVDW YLQKPGQSPHLLIYFGSYRASGVPDRFSGSGSGTDFTLKI SRVEAEDVGVYYCMQALQTPPWTFGQGTKVEIRR |
| 37 | AB006VH | VH CD-19 | QVQLQQSGAELVRPGSSVKISCKASGYAFSSYWMNWVKQR PGQGLEWIGQIWPGDGDTNYNGKFKGKATLTADESSSTAY MQLSSLASEDSAVYFCARRETTTVGRYYYAMDYWGQGTSV TVSS |
| 38 | AB006VL | VL CD-19 | DILLTQTPASLAVSLGQRATISCKASQSVDYDGDSYLNWY QQIPGQPPKLLIYDASNLVSGIPPRFSGSGSGTDFTLNIH PVEKVDAATYHCQQSTEDPWTFGGGTKLEIKR |
| 39 | AB007VH | VH CD-80 | QVQLQESGPGLVKPSETLSLTCAVSGGSISGGYGWGWIRQ PPGKGLEWIGSFYSSSGNTYYNPSLKSQVTISTDTSKNQF SLKLNSMTAADTAVYYCVRDRLFSVVGMVYNNWFDVWGPG VLVTVSS |
| 40 | AB007VL | VL CD-80 | ESALTQPPSVSGAPGQKVTISCTGSTSNIGGYDLHWYQQL PGTAPKLLIYDINKRPSGISDRFSGSKSGTAASLAITGLQ TEDEADYYCQSYDSSLNAQVFGGGTRLTVLG |
| 41 | AB008VH | VH CD-22 | QVQLVQSGAEVKKPGSSVKVSCKASGYTFTSYWLHWVRQA PGQGLEWIGYINPRNDYTEYNQNFKDKATITADESTNTAY MELSSLRSEDTAFYFCARRDITTFYWGQGTTVTVSS |
| 42 | AB008VL | VL CD-22 | DIQLTQSPSSLSASVGDRVTMSCKSSQSVLYSANHKNYLA WYQQKPGKAPKLLIYWASTRESGVPSRFSGSGSGTDFTFT ISSLQPEDIATYYCHQYLSSWTFGGGTKLEIKR |
| 43 | AB009VH | VH CD-40 | QVQLVESGGGVVQPGRSLRLSCAASGFTFSSYGMHWVRQA PGKGLEWVAVISYEESNRYHADSVKGRFTISRDNSKITLY LQMNSLRTEDTAVYYCARDGGIAAPGPDYWGQGTLVTVSS |
| 44 | AB009VL | VL CD-40 | DIVMTQSPLSLTVTPGEPASISCRSSQSLLYSNGYNYLDW YLQKPGQSPQVLISLGSNRASGVPDRFSGSGSGTDFTLKI SRVEAEDVGVYYCMQARQTPFTFGPGTKVDIRR |
| 45 | AB010VH | VH IGF1, 2 | QVQLVQSGAEVKKPGASVKVSCKASGYTFTSYDINWVRQA TGQGLEWMGWMNPNSGNTGYAQKFQGRVTMTRNTSISTAY MELSSLRSEDTAVYYCARDPYYYYYGMDVWGQGTTVTVSS |
| 46 | AB010VL | VL IGF1, 2 | QSVLTQPPSVSAAPGQKVTISCSGSSSNIENNHVSWYQQL PGTAPKLLIYDNNKRPSGIPDRFSGSKSGTSATLGITGLQ TGDEADYYCETWDTSLSAGRVFGGGTKLTVLG |
| 47 | AB011VH | VH IGF1R (seq. 1) | EVQLLESGGGLVQPGGSLRLSCTASGFTFSSYAMNWVRQA PGKGLEWVSAISGSGGTTFYADSVKGRFTISRDNSRTTLY LQMNSLRAEDTAVYYCAKDLGWSDSYYYYYGMDVWGQGTT VTVSS |
| 48 | AB011VL | VL IGF1R (seq. 1) | DIQMTQFPSSLSASVGDRVTITCRASQGIRNDLGWYQQKP GKAPKRLIYAASRLHRGVPSRFSGSGSGTEFTLTISSLQP EDFATYYCLQHNSYPCSFGQGTKLEIKR |
| 49 | AB012VH | VH HGF (seq. 1) | QVQLVESGGGLVKPGGSLRLSCAASGFTFSDYYMSWIRQA PGKGLEWVSYISSSGSTIYYADSVKGRFTISRDNAKNSLY LQMNSLRAEDTAVYYCARDEYNSGWYVLFDYWGQGTLVTV SS |

TABLE 2-continued

List of Amino Acid Sequences of VH and VL regions of
Antibodies for Generating DVD-Igs

| SEQ ID No. | ABT Unique ID | Protein region | Sequence |
|---|---|---|---|
| 50 | AB012VL | VL HGF (seq. 1) | DIQMTQSPSSVSASVGDRVTITCRASQGISSWLAWYQQKP GKAPNLLIYEASSLQSGVPSRFGGSGSGTDFTLTISSLQP EDFATYYCQQANGFPWTFGQGTKVEIKR |
| 51 | AB013VH | VH c-MET | QVQLQQSGPELVRPGASVKWSCPASGYTFTSYWLHWVKKQ RPGQGLEWIGMIDPSNSDTRFNPPNFKDKATLNVDRSSNT AYNLLSSLTSADSAVYYCATYGSYVSPLDYWGQGTSVYVSS |
| 52 | AB013VL | VL c-MET | DIMMSQSPSSLTVSVGEKVTVSCKSSQSLLVTSSQKNYLA WYQQKPQQSPKLLIYWASTRESGVPDRFTGSGSGTDFTLT ITSVKADDLAVYYCQQYYAYPWTFGDGTKLEIKR |
| 53 | AB014VH | VH VEGF (seq. 1) | EVQLVESGGGLVQPGGSLRLSCAASGYTFTNYGMNWVRQA PGKGLEWVGWINTYTGEPTYAADFKRRFTFSLDTSKSTAY LQMNSLRAEDTAVYYCAKYPHYYGSSHWYFDVWGQGTLVT VSS |
| 54 | AB014VL | VL VEGF (seq. 1) | DIQMTQSPSSLSASVGDRVTITCSASQDISNYLNWYQQKP GKAPKVLIYFTSSLHSGVPSRFSGSGSGTDFTLTISSLQP EDFATYYCQQYSTVPWTFGQGTKVEIKR |
| 55 | AB015VH | VH DLL-4 (seq. 1) | EVQLVESGGGLVQPGGSLRLSCAASGFTFTDNWISWVRQA PGKGLEWVGYISPNSGFTYYADSVKGRFTISADTSKNTAY LQMNSLRAEDTAVYYCARDNFGGYFDYWGQGTLVTVSS |
| 56 | AB015VL | VL DLL-4 (seq. 1) | DIQMTQSPSSLSASVGDRVTITCRASQDVSTAVAWYQQKP GKAPKLLIYSASFLYSGVPSRFSGSGSGTDFTLTISSLQP EDFATTYYCQQSYTGTVTFGQGTKVEIKR |
| 57 | AB016VH | VH NRP1 (seq. 1) | EVQLVESGGGLVQPGGSLRLSCAASGFSFSSEPISWVRQA PGKGLEWVSSITGKNGYTYYADSVKGRFTISADTSKNTAY LQMNSLRAEDTAVYYCARWGKKVYGMDVWGQGTLVTVSS |
| 58 | AB016VL | VL NRP1 (seq. 1) | DIQMTQSPSSLSASVGDRVTITCRASQSISSYLAWYQQKP GKAPKLLIYGASSRASGVPSRFSGSGSGTDFTLTISSLQP EDFATYYCQQYMSVPITFGQGTKVEIKR |
| 59 | AB033VH | VH EGFR (seq. 2) | QVQLKQSGPGLVQPSQSLSITCTVSGFSLTNYGVHWVRQS PGKGLEWLGVIWSGGNTDYNTPFTSRLSINKDNSKSQVFF KMNSLQSNDTAIYYCARALTYYDYEFAYWGQGTLVTVSA |
| 60 | AB033VL | VL EGFR (seq. 2) | DILLTQSPVILSVSPGERVSFSCRASQSIGTNIHWYQQRT NGSPRLLIKYASESISGIPSRFSGSGSGTDFTLSINSVES EDIADYYCQQNNNWPTTFGAGTKLELKR |
| 61 | AB034VH | VH RON (seq. 2) | QVQLQESGPGLVKPSEILSLTCTVSGGSISSHYWSWVRQP PGKGLEWIGYIYYSGSTNYNPSLKSRVTISVDTSKNQFSL NLSSVTAADTAVYYCARIPNYYDRSGYYPGYWYFDLWGRG TLVTVSS |
| 62 | AB034VL | VL RON (seq. 2) | QAVLTQPSSLSAPPGASASLTCTLRSGFNVDSYRISWYQQ KPGSPPQYLLRYKSDSDKQQGSGVPSRFSGSKDASANAGI LLISGLQSEDEADYYCMIWHSSAWVFGGGTKLTVLR |
| 63 | AB035VH | VH NRP1 (seq. 2) | EVQLVESGGGLVQPGGSLRLSCAASGFTFSSYAMSWVRQA PGKGLEWVSQISPAGGYTNYADSVKGRFTISADTSKNTAY LQMNSLRAEDTAVYYCARELPYYRMSKVMDVQGQGTLVTV SS |
| 64 | AB035VL | VL NRP1 (seq. 2) | DIQMTQSPSSLSASVGDRVTITCRASQYFSSYLAWYQQKP GKAPKLLIYGASSRASGVPSRFSGSGSGTDFTLTISSLQP EDFATYYCQQYLGSPPTFGQGTKVEIKR |
| 65 | AB039VH | VH CD3 (seq. 2) | QVQLQQSGAELARPGASVKMSCKASGYTFTRYTMHWVKQR PGQGLEWIGYINPSRGYTNYNQKFKDKATLTTDKSSSTAY MQLSSLTSEDSAVYYCARYYDDHYCLDYWGQGTTLTVSS |
| 66 | AB039VL | VL CD3 (seq. 2) | QIVLTQSPAIMSASPGEKVTMTCSASSSVSYMNWYQQKSG TSPKRWIYDTSKLASGVPAHFRGSGSGTSYSLTISGMEAE DAATYYCQQWSSNPFTFGSGTKLEINR |

TABLE 2-continued

List of Amino Acid Sequences of VH and VL regions of
Antibodies for Generating DVD-Igs

| SEQ ID No. | ABT Unique ID | Protein region | Sequence<br>123456789012345678901234567890 |
|---|---|---|---|
| 67 | AB047VH | VH PLGF (seq. 1) | QVQLQQSGAELVKPGASVKISCKASGYTFTDYYINWVKLA<br>PGQGLEWIGWIYPGSGNTKYNEKFKGKATLTIDTSSSTAY<br>MQLSSLTSEDTAVYFCVRDSPFFDYWGQGTLLTVSS |
| 68 | AB047VL | VL PLGF (seq. 1) | DIVLTQSPDSLAVSLGERVTMNCKSSQSLLNSGMRKSFLA<br>WYQQKPGQSPKLLIYWASTRESGVPDRFTGSGSGTDFTLT<br>ISSVQAEDVAVYYCKQSYHLFTFGSGTKLEIKR |
| 69 | AB062VH | VH ErbB3 (seq. 1) | QVQLQQWGAGLLKPSETLSLTCAVYGGSFSGYYWSWIRQP<br>PGKGLEWIGEINHSGSTNYNPSLKSRVTISVETSKNQFSL<br>KLSSVTAADTAVYYCARDKWTWYFDLWGRGTLVTVSS |
| 70 | AB062VL | VL ErbB3 (seq. 1) | DIEMTQSPDSLAVSLGERATINCRSSQSVLYSSSNRNYLA<br>WYQQNPGQPPKLLIYWASTRESGVPDRFSGSGSGTDFTLT<br>ISSLQAEDVAVYYCQQYYSTPRTFGQGTKVEIKR |
| 71 | AB063VH | VH ErbB3 (seq. 2) | EVQLVESGGGLVQPGGSLRLSCAASGFTFSIYSMNWVRQA<br>PGKGLEWVSYISSSSSTIYYADSVKGRFTISRDNAKNSLY<br>LQMNSLRDEDTAVYYCARDRGDFDAFDIWGQGTMVTVSS |
| 72 | AB063VL | VL ErbB3 (seq. 2) | DIQMTQSPSSLSASVGDRVTITCQASQDITNYLNWYQQKP<br>GKAPKLLIYDASNLETGVPSRFSGSGSGTDFTFTISSLQP<br>EDIATYNCQQCENFPITFGQGTRLEIKR |
| 73 | AB067VH | VH ErbB3 (seq. 3) | EVQLLESGGGLVQPGGSLRLSCAASGFTFSHYVMAWVRQA<br>PGKGLEWVSSISSSGGWTLYADSVKGRFTISRDNSKNTLY<br>LQMNSLRAEDTAVYYCTRGLKMATIFDYWGQGTLVTVSS |
| 74 | AB067VL | VL ErbB3 (seq. 3) | QSALTQPASVSGSPGQSITISCTGTSSDVGSYNVVSWYQQ<br>HPGKAPKLIIYEVSQRPSGVSNRFSGSKSGNTASLTISGL<br>QTEDEADYYCCSYAGSSIFVIFGGGTKVTVLG |
| 75 | AB069VH | VH DLL4 (seq. 2) | QVQLVQSGAEVKKPGASVKISCKASGYSFTAYYIHWVKQA<br>PGQGLEWIGYISSYNGATNYNQKFKGRVTFTTDTSTSTAY<br>MELRSLRSDDTAVYYCARDYDYVGMDYWGQGTLVTVSS |
| 76 | AB069VL | VL DLL4 (seq. 2) | DIVMTQSPDSLAVSLGERATISCRASESVDNYGISFMKWF<br>QQKPGQPPKLLIYAASNQGSGVPDRFSGSGSGTDFTLTIS<br>SLQAEDVAVYYCQQSKEVPWTFGGGTKVEIKR |
| 77 | AB070VH | VH VEGF (seq. 2) | EVQLVESGGGLVQPGGSLRLSCAASGFTISDYWIHWVRQA<br>PGKGLEWVAGITPAGGYTYYADSVKGRFTISADTSKNTAY<br>LQMNSLRAEDTAVYYCARFVFFLPYAMDYWGQGTLVTVSS |
| 78 | AB070VL | VL VEGF (seq. 2) | DIQMTQSPSSLSASVGDRVTITCRASQDVSTAVAWYQQKP<br>GKAPKLLIYSASFLYSGVPSRFSGSGSGTDFTLTISSLQP<br>EDFATYYCQQSYTTPPTFGQGTKVEIKR |
| 79 | AB071VH | VH VEGF (seq. 3) | EVQLVESGGGLVQPGGSLRLSCAASGFTINASWIHWVRQA<br>PGKGLEWVGAIYPYSGYTNYADSVKGRFTISADTSKNTAY<br>LQMNSLRAEDTAVYYCARWGHSTSPWAMDYWGQGTLVTVSS |
| 80 | AB071VL | VL VEGF (seq. 3) | DIQMTQSPSSLSASVGDRVTITCRASQVIRRSLAWYQQKP<br>GKAPKLLIYAASNLASGVPSRFSGSGSGTDFTLTISSLQP<br>EDFATYYCQQSNTSPLTFGQGTKVEIKR |
| 81 | AB072VH | VH DLL4 (seq. 3) | EVQLQQSGPELVKPGASVKMSCKASGYTFTSYVINWVKQK<br>PGQGLEWIGLINPYNDGTKYNEKFKVKATLTSDKSSSTAY<br>MELSSLTSEDSAVYYCASYYYGSRYYFDYWGQGTTLTVSS |
| 82 | AB072VL | VL DLL4 (seq. 3) | DIQMTQSSSYLSVSLGGRVTITCKASDHINNWLAWYQQKP<br>GNAPRLLISGATSLETGVPSRFSGSGSGKDYTLSITSLQT<br>EDVATYYCQQYWSIPLTFGAGTKLELKR |
| 83 | AB073VH | VH DLL4 (seq. 4) | EVQLQQSGPELEKPGASVKISCKASGYSFTGYNMNWVKQS<br>NGKSLEWIGNIDPYFGGTNYNQKFKGKATLTVDKSSSTAY<br>MQLKSLTSEDSAVYYCARNYDYDGGCFDYWGQGTTLTVSS |
| 84 | AB073VL | VL DLL4 (seq. 4) | QAVVTQESALTTSPGETVTLTCRSSTGAVTTSNYANWVQE<br>KPDHLFTGLIGGTNNRAPGVPARFSGSLIGDKAALTITGA<br>QTEDEAIYFCALWYSNHWVFGGGTKLTVLG |

TABLE 2-continued

List of Amino Acid Sequences of VH and VL regions of
Antibodies for Generating DVD-Igs

| SEQ ID No. | ABT Unique ID | Protein region | Sequence<br>123456789012345678901234567890123456789 0 |
|---|---|---|---|
| 85 | AB074VH | VH PLGF (seq. 2) | QVQLKQSGPGLVQPSQSLSITCTVSGFSLTTYGIHWVRQS PGKGLEWLGVMWSGGDTDYDAAFISRLSISKDNSKSQVFF KMNSLQANDTGIYYCARYRFYGMDYWGQGTSVTVSS |
| 86 | AB074VL | VL PLGF (seq. 2) | AIQMTQSSSSFSVSLGDRVTITCKASEDIYNRFAWYQQKP GNAPRLLISGAASLEAGVPSRFSGSGSGQDYTLSITSLQT EDVATYYCQQYWSTPWTFGGGTKLEIKR |
| 87 | AB075VH | VH IGF1R (seq. 2) | EVQLVQSGAEVKKPGSSVKVSCKASGGTFSSYAISWVRQA PGQGLEWMGGIIPIFGTANYAQKFQGRVTITADKSTSTAY MELSSLRSEDTAVYYCARAPLRFLEWSTQDHYYYYMDVW GKGTTVTVSS |
| 88 | AB075VL | VL IGF1R (seq. 2) | SSELTQDPAVSVALGQTVRITCQGDSLRSYYATWYQQKPG QAPILVIYGENKRPSGIPDRFSGSSSGNTASLTITGAQAE DEADYYCKSRDGSGQHLVFGGGTKLTVLG |
| 89 | AB077VH | VH IGF1R (seq. 3) | EVQLVQSGGGLVKPGGSLRLSCAASGFTFSSFAMHWVRQA PGKGLEWISVIDTRGATYYADSVKGRFTISRDNAKNSLYL QMNSLRAEDTAVYYCARLGNFYYGMDVWGQGTTVTVSS |
| 90 | AB077VL | VL IGF1R (seq. 3) | EIVLTQSPGTLSVSPGERATLSCRASQSIGSSLHWYQQKP GQAPRLLIKYASQSLSGIPDRFSGSGSGTDFTLTISRLEP EDFAVYYCHQSSRLPHTFGQGTKVEIKR |
| 91 | AB079VH | VH HGF (seq. 2) | EVQLVQSGAEVKKPGESLKISCKGSGYSFTTYWMHWVRQM PGKGLEWMGEINPTNGHTNYNPSFQGQVTISADKSISTAY LQWSSLKASDTAMYYCARNYVGSIFDYWGQGTLVTVSS |
| 92 | AB079VL | VL HGF (seq. 2) | DIQMTQSPSSLSASVGDRVTITCKASENVVSYVSWYQQKP GKAPKLLIYGASNRNTGVPSRFSGSGSGTDFTLTISSLQP EDFATYYCGQSYNYPYTFGQGTKLEIKR |
| 93 | AB080VH | VH HER2 (seq. 2) | EVQLVESGGGLVQPGGSLRLSCAASGFTFTDYTMDWVRQA PGKGLEWVADVNPNSGGSIYNQRFKGRFTLSVDRSKNTLY LQMNSLRAEDTAVYYCARNLGPSFYFDYWGQGTLVTVSS |
| 94 | AB080VL | VL HER2 (seq. 2) | DIQMTQSPSSLSASVGDRVTITCKASQDVSIGVAWYQQKP GKAPKLLIYSASYRYTGVPSRFSGSGSGTDFTLTISSLQP EDFATYYCQQYYIYPYTFGQGTKVEIKR |

Detailed description of specific DVD-Ig molecules capable of binding specific targets, and methods of making the same, is provided in the Examples section below.

C. Production of DVD Proteins

Binding proteins of the present invention may be produced by any of a number of techniques known in the art. For example, expression from host cells, wherein expression vector(s) encoding the DVD heavy and DVD light chains is (are) transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection and the like. Although it is possible to express the DVD proteins of the invention in either prokaryotic or eukaryotic host cells, DVD proteins are expressed in eukaryotic cells, for example, mammalian host cells, because such eukaryotic cells (and in particular mammalian cells) are more likely than prokaryotic cells to assemble and secrete a properly folded and immunologically active DVD protein.

Exemplary mammalian host cells for expressing the recombinant antibodies of the invention include Chinese Hamster Ovary (CHO cells) (including dhfr– CHO cells, described in Urlaub and Chasin, (1980) *Proc. Natl. Acad. Sci. USA* 77:4216-4220, used with a DHFR selectable marker, e.g., as described in R. J. Kaufman and P. A. Sharp (1982) *Mol. Biol.* 159:601-621), NS0 myeloma cells, COS cells, SP2 and PER.C6 cells. When recombinant expression vectors encoding DVD proteins are introduced into mammalian host cells, the DVD proteins are produced by culturing the host cells for a period of time sufficient to allow for expression of the DVD proteins in the host cells or secretion of the DVD proteins into the culture medium in which the host cells are grown. DVD proteins can be recovered from the culture medium using standard protein purification methods.

In an exemplary system for recombinant expression of DVD proteins of the invention, a recombinant expression vector encoding both the DVD heavy chain and the DVD light chain is introduced into dhfr– CHO cells by calcium phosphate-mediated transfection. Within the recombinant expression vector, the DVD heavy and light chain genes are each operatively linked to CMV enhancer/AdMLP promoter regulatory elements to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the DVD heavy and light chains and intact DVD protein is recovered from the culture medium. Standard molecular biology techniques are used to prepare the recombinant expression vector, transfect the host cells, select for transformants, culture the host cells and recover the DVD protein from the culture medium. Still further the invention provides a method of synthesizing a DVD protein of the invention by culturing a host cell of the invention in a suitable culture medium until a DVD protein of the invention is synthesized. The method can further comprise isolating the DVD protein from the culture medium.

An important feature of DVD-Ig is that it can be produced and purified in a similar way as a conventional antibody. The production of DVD-Ig results in a homogeneous, single major product with desired dual-specific activity, without any sequence modification of the constant region or chemical modifications of any kind. Other previously described methods to generate "bi-specific", "multi-specific", and "multi-specific multivalent" full length binding proteins do not lead to a single primary product but instead lead to the intracellular or secreted production of a mixture of assembled inactive, mono-specific, multi-specific, multivalent, full length binding proteins, and multivalent full length binding proteins with combination of different binding sites. As an example, based on the design described by Miller and Presta (PCT publication WO2001/077342(A1), there are 16 possible combinations of heavy and light chains. Consequently only 6.25% of protein is likely to be in the desired active form, and not as a single major product or single primary product compared to the other 15 possible combinations. Separation of the desired, fully active forms of the protein from inactive and partially active forms of the protein using standard chromatography techniques, typically used in large scale manufacturing, is yet to be demonstrated.

Surprisingly the design of the "dual-specific multivalent full length binding proteins" of the present invention leads to a dual variable domain light chain and a dual variable domain heavy chain which assemble primarily to the desired "dual-specific multivalent full length binding proteins".

At least 50%, at least 75% and at least 90% of the assembled, and expressed dual variable domain immunoglobulin molecules are the desired dual-specific tetravalent protein. This aspect of the invention particularly enhances the commercial utility of the invention. Therefore, the present invention includes a method to express a dual variable domain light chain and a dual variable domain heavy chain in a single cell leading to a single primary product of a "dual-specific tetravalent full length binding protein".

The present invention provides a methods of expressing a dual variable domain light chain and a dual variable domain heavy chain in a single cell leading to a "primary product" of a "dual-specific tetravalent full length binding protein", where the "primary product" is more than 50% of all assembled protein, comprising a dual variable domain light chain and a dual variable domain heavy chain.

The present invention provides methods of expressing a dual variable domain light chain and a dual variable domain heavy chain in a single cell leading to a single "primary product" of a "dual-specific tetravalent full length binding protein", where the "primary product" is more than 75% of all assembled protein, comprising a dual variable domain light chain and a dual variable domain heavy chain.

The present invention provides methods of expressing a dual variable domain light chain and a dual variable domain heavy chain in a single cell leading to a single "primary product" of a "dual-specific tetravalent full length binding protein", where the "primary product" is more than 90% of all assembled protein, comprising a dual variable domain light chain and a dual variable domain heavy chain.

II. Derivatized DVD Binding Proteins:

One embodiment provides a labeled binding protein wherein the binding protein of the invention is derivatized or linked to another functional molecule (e.g., another peptide or protein). For example, a labeled binding protein of the invention can be derived by functionally linking an binding protein of the invention (by chemical coupling, genetic fusion, non-covalent association or otherwise) to one or more other molecular entities, such as another antibody (e.g., a bispecific antibody or a diabody), a detectable agent, a cytotoxic agent, a pharmaceutical agent, and/or a protein or peptide that can mediate association of the binding protein with another molecule (such as a streptavidin core region or a polyhistidine tag).

Useful detectable agents with which a binding protein of the invention may be derivatized include fluorescent compounds. Exemplary fluorescent detectable agents include fluorescein, fluorescein isothiocyanate, rhodamine, 5-dimethylamine-1-napthalenesulfonyl chloride, phycoerythrin and the like. A binding protein may also be derivatized with detectable enzymes, such as alkaline phosphatase, horseradish peroxidase, glucose oxidase and the like. When a binding protein is derivatized with a detectable enzyme, it is detected by adding additional reagents that the enzyme uses to produce a detectable reaction product. For example, when the detectable agent horseradish peroxidase is present, the addition of hydrogen peroxide and diaminobenzidine leads to a colored reaction product, which is detectable. A binding protein may also be derivatized with biotin, and detected through indirect measurement of avidin or streptavidin binding.

Another embodiment of the invention provides a crystallized binding protein and formulations and compositions comprising such crystals. In one embodiment the crystallized binding protein has a greater half-life in vivo than the soluble counterpart of the binding protein. In another embodiment the binding protein retains biological activity after crystallization.

Crystallized binding protein of the invention may be produced according to methods known in the art and as disclosed in WO 02072636, incorporated herein by reference.

Another embodiment of the invention provides a glycosylated binding protein wherein the antibody or antigen-binding portion thereof comprises one or more carbohydrate residues. Nascent in vivo protein production may undergo further processing, known as post-translational modification. In particular, sugar (glycosyl) residues may be added enzymatically, a process known as glycosylation. The resulting proteins bearing covalently linked oligosaccharide side chains are known as glycosylated proteins or glycoproteins. Antibodies are glycoproteins with one or more carbohydrate residues in the Fc domain, as well as the variable domain. Carbohydrate residues in the Fc domain have important effect on the effector function of the Fc domain, with minimal effect on antigen binding or half-life of the antibody (R. Jefferis, *Biotechnol. Prog.* 21 (2005), pp. 11-16). In contrast, glycosylation of the variable domain may have an effect on the antigen binding activity of the antibody. Glycosylation in the variable domain may have a negative effect on antibody binding affinity, likely due to steric hindrance (Co, M. S., et al., Mol. Immunol. (1993) 30:1361-1367), or result in increased affinity for the antigen (Wallick, S. C., et al., Exp. Med. (1988) 168:1099-1109; Wright, A., et al., EMBO J. (1991) 10:2717 2723).

One aspect of the present invention is directed to generating glycosylation site mutants in which the O- or N-linked glycosylation site of the binding protein has been mutated. One skilled in the art can generate such mutants using standard well-known technologies. Glycosylation site mutants that retain the biological activity but have increased or decreased binding activity are another object of the present invention.

In still another embodiment, the glycosylation of the antibody or antigen-binding portion of the invention is modified. For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region glycosylation sites to thereby eliminate glycosylation at that site. Such aglycosylation may increase the affinity of the antibody for antigen. Such an approach is described in further detail in PCT Publication WO2003016466A2, and U.S. Pat. Nos. 5,714,350 and 6,350,861, each of which is incorporated herein by reference in its entirety.

Additionally or alternatively, a modified binding protein of the invention can be made that has an altered type of glycosylation, such as a hypofucosylated antibody having reduced amounts of fucosyl residues (see Kanda, Yutaka et al., Journal of Biotechnology (2007), 130(3), 300-310.) or an antibody having increased bisecting GlcNAc structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies of the invention to thereby produce an antibody with altered glycosylation. See, for example, Shields, R. L. et al. (2002) J. Biol. Chem. 277: 26733-26740; Umana et al. (1999) Nat. Biotech. 17:176-1, as well as, European Patent No: EP 1,176,195; PCT Publications WO 03/035835; WO 99/54342 80, each of which is incorporated herein by reference in its entirety.

Protein glycosylation depends on the amino acid sequence of the protein of interest, as well as the host cell in which the protein is expressed. Different organisms may produce different glycosylation enzymes (e.g., glycosyltransferases and glycosidases), and have different substrates (nucleotide sugars) available. Due to such factors, protein glycosylation pattern, and composition of glycosyl residues, may differ depending on the host system in which the particular protein is expressed. Glycosyl residues useful in the invention may include, but are not limited to, glucose, galactose, mannose, fucose, n-acetylglucosamine and sialic acid. In an embodiment, the glycosylated binding protein comprises glycosyl residues such that the glycosylation pattern is human.

It is known to those skilled in the art that differing protein glycosylation may result in differing protein characteristics. For instance, the efficacy of a therapeutic protein produced in a microorganism host, such as yeast, and glycosylated utilizing the yeast endogenous pathway may be reduced compared to that of the same protein expressed in a mammalian cell, such as a CHO cell line. Such glycoproteins may also be immunogenic in humans and show reduced half-life in vivo after administration. Specific receptors in humans and other animals may recognize specific glycosyl residues and promote the rapid clearance of the protein from the bloodstream. Other adverse effects may include changes in protein folding, solubility, susceptibility to proteases, trafficking, transport, compartmentalization, secretion, recognition by other proteins or factors, antigenicity, or allergenicity. Accordingly, a practitioner may choose a therapeutic protein with a specific composition and pattern of glycosylation, for example glycosylation composition and pattern identical, or at least similar, to that produced in human cells or in the species-specific cells of the intended subject animal.

Expressing glycosylated proteins different from that of a host cell may be achieved by genetically modifying the host cell to express heterologous glycosylation enzymes. Using techniques known in the art a practitioner may generate antibodies or antigen-binding portions thereof exhibiting human protein glycosylation. For example, yeast strains have been genetically modified to express non-naturally occurring glycosylation enzymes such that glycosylated proteins (glycoproteins) produced in these yeast strains exhibit protein glycosylation identical to that of animal cells, especially human cells (U.S. patent applications 20040018590 and 20020137134 and PCT publication WO2005100584 A2).

In addition to the binding proteins, the present invention is also directed to anti-idiotypic (anti-Id) antibodies specific for such binding proteins of the invention. An anti-Id antibody is an antibody, which recognizes unique determinants generally associated with the antigen-binding region of another antibody. The anti-Id can be prepared by immunizing an animal with the binding protein or a CDR containing region thereof. The immunized animal will recognize, and respond to the idiotypic determinants of the immunizing antibody and produce an anti-Id antibody. It is readily apparent that it may be easier to generate anti-idiotypic antibodies to the two or more parent antibodies incorporated into a DVD-Ig molecule; and confirm binding studies by methods well recognized in the art (e.g., BIAcore, ELISA) to verify that anti-idiotypic antibodies specific for the idiotype of each parent antibody also recognize the idiotype (e.g., antigen binding site) in the context of the DVD-Ig. The anti-idiotypic antibodies specific for each of the two or more antigen binding sites of a DVD-Ig provide ideal reagents to measure DVD-Ig concentrations of a human DVD-Ig in patient serum; DVD-Ig concentration assays can be established using a "sandwich assay ELISA format" with an antibody to a first antigen binding regions coated on the solid phase (e.g., BIAcore chip, ELISA plate etc.), rinsed with rinsing buffer, incubation with the serum sample, another rinsing step and ultimately incubation with another anti-idiotypic antibody to the another antigen binding site, itself labeled with an enzyme for quantitation of the binding reaction. In an embodiment, for a DVD-Ig with more than two different binding sites, anti-idiotypic antibodies to the two outermost binding sites (most distal and proximal from the constant region) will not only help in determining the DVD-Ig concentration in human serum but also document the integrity of the molecule in vivo. Each anti-Id antibody may also be used as an "immunogen" to induce an immune response in yet another animal, producing a so-called anti-anti-Id antibody.

Further, it will be appreciated by one skilled in the art that a protein of interest may be expressed using a library of host cells genetically engineered to express various glycosylation enzymes, such that member host cells of the library produce the protein of interest with variant glycosylation patterns. A practitioner may then select and isolate the protein of interest with particular novel glycosylation patterns. In an embodiment, the protein having a particularly selected novel glycosylation pattern exhibits improved or altered biological properties.

III. Uses of DVD-Ig

Given their ability to bind to two or more antigens the binding proteins of the invention can be used to detect the antigens (e.g., in a biological sample, such as serum or plasma), using a conventional immunoassay, such as an enzyme linked immunosorbent assays (ELISA), an radioimmunoassay (RIA) or tissue immunohistochemistry. The DVD-Ig is directly or indirectly labeled with a detectable substance to facilitate detection of the bound or unbound antibody. Suitable detectable substances include various enzymes, prosthetic groups, fluorescent materials, luminescent materials and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; and examples of suitable radioactive material include $^{3}H$, $^{14}C$, $^{35}S$, $^{90}Y$, $^{99}Tc$, $^{111}In$, $^{125}I$, $^{131}I$, $^{177}Lu$, $^{166}Ho$, or $^{153}Sm$.

In an embodiment, the binding proteins of the invention are capable of neutralizing the activity of the antigens both in vitro and in vivo. Accordingly, such DVD-Igs can be used to inhibit antigen activity, e.g., in a cell culture containing the antigens, in human subjects or in other mammalian subjects having the antigens with which a binding protein of the invention cross-reacts. In another embodiment, the invention provides a method for reducing antigen activity in a subject suffering from a disease or disorder in which the antigen activity is detrimental. A binding protein of the invention can be administered to a human subject for therapeutic purposes.

As used herein, the term "a disorder in which antigen activity is detrimental" is intended to include diseases and other disorders in which the presence of the antigen in a subject suffering from the disorder has been shown to be or is suspected of being either responsible for the pathophysiology of the disorder or a factor that contributes to a worsening of the disorder. Accordingly, a disorder in which antigen activity is detrimental is a disorder in which reduction of antigen activity is expected to alleviate the symptoms and/or progression of the disorder. Such disorders may be evidenced, for example, by an increase in the concentration of the antigen in a biological fluid of a subject suffering from the disorder (e.g., an increase in the concentration of antigen in serum, plasma, synovial fluid, etc. of the subject). Non-limiting examples of disorders that can be treated with the binding proteins of the invention include those disorders discussed below and in the section pertaining to pharmaceutical compositions of the antibodies of the invention.

The DVD-Igs of the invention may bind one antigen or multiple antigens. Such antigens include, but are not limited to, therapeutic targets (see, e.g., the Bioinformatics and Drug Design Group of the National University of Singapore), cytokines and cytokine receptors (see, e.g., the Cytokines & Cells Online Pathfinder Encyclopedia), chemokines, chemokine receptors and GPCRs, olfactory receptors (see, e.g., SenseLab at Yale University), receptors (see, e.g., the IUPHAR Committee on Receptor Nomenclature and Drug Classification), cancer targets (see, e.g., the Human Genome Center at the Institute of Medical Science, University of Tokyo), secreted proteins and protein kinases (see, e.g., the Secreted Protein Database from the Center of Bioinformatics, Peking University), and human CD markers (see, e.g., Zola H, 2005, CD molecules 2005: human cell differentiation molecules, Blood, 106:3123-6).

DVD-Igs are useful as therapeutic agents to simultaneously block two different targets to enhance efficacy/safety and/or increase patient coverage. Such targets may include soluble targets (TNF) and cell surface receptor targets (VEGFR and EGFR). It can also be used to induce redirected cytotoxicity between tumor cells and T cells (Her2 and CD3) for cancer therapy, or between autoreactive cell and effector cells for autoimmune disease or transplantation, or between any target cell and effector cell to eliminate disease-causing cells in any given disease.

In addition, DVD-Ig can be used to trigger receptor clustering and activation when it is designed to target two different epitopes on the same receptor. This may have benefit in making agonistic and antagonistic anti-GPCR therapeutics. In this case, DVD-Ig can be used to target two different epitopes (including epitopes on both the loop regions and the extracellular domain) on one cell for clustering/signaling (two cell surface molecules) or signaling (on one molecule). Similarly, a DVD-Ig molecule can be designed to trigger CTLA-4 ligation, and a negative signal by targeting two different epitopes (or 2 copies of the same epitope) of CTLA-4 extracellular domain, leading to down regulation of the immune response. CTLA-4 is a clinically validated target for therapeutic treatment of a number of immunological disorders. CTLA-4/B7 interactions negatively regulate T cell activation by attenuating cell cycle progression, IL-2 production, and proliferation of T cells following activation, and CTLA-4 (CD152) engagement can down-regulate T cell activation and promote the induction of immune tolerance. However, the strategy of attenuating T cell activation by agonistic antibody engagement of CTLA-4 has been unsuccessful since CTLA-4 activation requires ligation. The molecular interaction of CTLA-4/B7 is in "skewed zipper" arrays, as demonstrated by crystal structural analysis (Stamper 2001 Nature 410:608). However none of the currently available CTLA-4 binding reagents have ligation properties, including anti-CTLA-4 mAbs. There have been several attempts to address this issue. In one case, a cell member-bound single chain antibody was generated, and significantly inhibited allogeneic rejection in mice (Hwang 2002 JI 169:633). In a separate case, artificial APC surface-linked single-chain antibody to CTLA-4 was generated and demonstrated to attenuate T cell responses (Griffin 2000 JI 164:4433). In both cases, CTLA-4 ligation was achieved by closely localized member-bound antibodies in artificial systems. While these experiments provide proof-of-concept for immune down-regulation by triggering CTLA-4 negative signaling, the reagents used in these reports are not suitable for therapeutic use. To this end, CTLA-4 ligation may be achieved by using a DVD-Ig molecule, which target two different epitopes (or 2 copies of the same epitope) of CTLA-4 extracellular domain. The rationale is that the distance spanning two binding sites of an IgG, approximately 150-170 Å, is too large for active ligation of CTLA-4 (30-50 Å between 2 CTLA-4 homodimer). However the distance between the two binding sites on DVD-Ig (one arm) is much shorter, also in the range of 30-50 Å, allowing proper ligation of CTLA-4.

Similarly, DVD-Ig can target two different members of a cell surface receptor complex (e.g., IL-12R alpha and beta). Furthermore, DVD-Ig can target CR1 and a soluble protein/pathogen to drive rapid clearance of the target soluble protein/pathogen.

Additionally, DVD-Igs of the invention can be employed for tissue-specific delivery (target a tissue marker and a disease mediator for enhanced local PK thus higher efficacy and/or lower toxicity), including intracellular delivery (targeting an internalizing receptor and a intracellular molecule), delivering to inside brain (targeting transferrin receptor and a CNS disease mediator for crossing the blood-brain barrier). DVD-Ig can also serve as a carrier protein to deliver an antigen to a specific location via binding to a non-neutralizing epitope of that antigen and also to increase the half-life of the antigen. Furthermore, DVD-Ig can be designed to either be physically linked to medical devices implanted into patients or target these medical devices (see Burke, Sandra E.; Kuntz, Richard E.; Schwartz, Lewis B., Zotarolimus eluting stents. Advanced Drug Delivery Reviews (2006), 58(3), 437-446; Surface coatings for biological activation and functionalization of medical devices, Hildebrand, H. F.; Blanchemain, N.; Mayer, G.; Chai, F.; Lefebvre, M.; Boschin, F., Surface and Coatings Technology (2006), 200(22-23), 6318-6324; Drug/device combinations for local drug therapies and infection prophylaxis, Wu, Peng; Grainger, David W., Biomaterials (2006), 27(11), 2450-2467; Mediation of the cytokine network in the implantation of orthopedic devices., Marques, A. P.; Hunt, J. A.; Reis, Rui L., Biodegradable Systems in Tissue Engineering and Regenerative Medicine (2005), 377-397). Briefly, directing appropriate types of cell to the site of medical implant may promote healing and restoring normal tissue function. Alternatively, inhibition of mediators (including but not limited to cytokines), released upon device implantation by a DVD coupled to or target to a device is also provided. For example, Stents have been used for years in interventional cardiology to clear blocked arteries and to improve the flow of blood to the heart muscle. However, traditional bare metal stents have been known to cause restenosis (re-narrowing of the artery in a treated area) in some patients and can lead to blood clots. Recently, an anti-CD34 antibody coated stent has been described which reduced restenosis and prevents blood clots from occurring by capturing endothelial progenitor cells (EPC) circulating throughout the blood. Endothelial cells are cells that line blood vessels, allowing blood to flow smoothly. The EPCs adhere to the hard surface of the stent forming a smooth layer that not only promotes healing but prevents restenosis and blood clots, complications previously associated with the use of stents (Aoji et al. 2005 J Am Coll Cardiol. 45(10):1574-9). In addition to improving outcomes for patients requiring stents, there are also implications for patients requiring cardiovascular bypass surgery. For example, a prosthetic vascular conduit (artificial artery) coated with anti-EPC antibodies would eliminate the need to use arteries from patients legs or arms for bypass surgery grafts. This would reduce surgery and anesthesia times, which in turn will reduce coronary surgery deaths. DVD-Ig are designed in such a way that it binds to a cell surface marker (such as CD34) as well as a protein (or an epitope of any kind, including but not limited to proteins, lipids and polysaccharides) that has been coated on the implanted device to facilitate the cell recruitment. Such approaches can also be applied to other medical implants in general. Alternatively, DVD-Igs can be coated on medical devices and upon implantation and releasing all DVDs from the device (or any other need which may require additional fresh DVD-Ig, including aging and denaturation of the already loaded DVD-Ig) the device could be reloaded by systemic administration of fresh DVD-Ig to the patient, where the DVD-Ig is designed to binds to a target of interest (a cytokine, a cell surface marker (such as CD34) etc.) with one set of binding sites and to a target coated on the device (including a protein, an epitope of any kind, including but not limited to lipids, polysaccharides and polymers) with the other. This technology has the advantage of extending the usefulness of coated implants.

A. Use of DVD-Igs in Various Diseases

DVD-Ig molecules of the invention are also useful as therapeutic molecules to treat various diseases. Such DVD molecules may bind one or more targets involved in a specific disease. Examples of such targets in various diseases are described below.

1. Human Autoimmune and Inflammatory Response

Many proteins have been implicated in general autoimmune and inflammatory responses, including C5, CCL1 (1-309), CCL11 (eotaxin), CCL13 (mcp-4), CCL15 (MIP-1d), CCL16 (HCC-4), CCL17 (TARC), CCL18 (PARC), CCL19, CCL2 (mcp-1), CCL20 (MIP-3a), CCL21 (MIP-2), CCL23 (MPIF-1), CCL24 (MPIF-2/eotaxin-2), CCL25 (TECK), CCL26, CCL3 (MIP-1a), CCL4 (MIP-1b), CCL5 (RANTES), CCL7 (mcp-3), CCL8 (mcp-2), CXCL1, CXCL10 (IP-10), CXCL11 (I-TAC/IP-9), CXCL12 (SDF1), CXCL13, CXCL14, CXCL2, CXCL3, CXCL5 (ENA-78/LIX), CXCL6 (GCP-2), CXCL9, IL13, IL8, CCL13 (mcp-4), CCR1, CCR2, CCR3, CCR4, CCR5, CCR6, CCR7, CCR8, CCR9, CX3CR1, IL8RA, XCR1 (CCXCR1), IFNA2, IL10, IL13, IL17C, IL1A, IL1B, IL1F10, IL1F5, IL1F6, IL1F7, IL1F8, IL1F9, IL22, IL5, IL8, IL9, LTA, LTB, MIF, SCYE1 (endothelial Monocyte-activating cytokine), SPP1, TNF, TNFSF5, IFNA2, IL10RA, IL10RB, IL13, IL13RA1, IL5RA, IL9, IL9R, ABCF1, BCL6, C3, C4A, CEBPB, CRP, ICEBERG, IL1R1, IL1RN, IL8RB, LTB4R, TOLLIP, FADD, IRAK1, IRAK2, MYD88, NCK2, TNFAIP3, TRADD, TRAF1, TRAF2, TRAF3, TRAF4, TRAF5, TRAF6, ACVR1, ACVR1B, ACVR2, ACVR2B, ACVRL1, CD28, CD3E, CD3G, CD3Z, CD69, CD80, CD86, CNR1, CTLA4, CYSLTR1, FCER1A, FCER2, FCGR3A, GPR44, HAVCR2, OPRD1, P2RX7, TLR2, TLR3, TLR4, TLR5, TLR6, TLR7, TLR8, TLR9, TLR10, BLR1, CCL1, CCL2, CCL3, CCL4, CCL5, CCL7, CCL8, CCL11, CCL13, CCL15, CCL16, CCL17, CCL18, CCL19, CCL20, CCL21, CCL22, CCL23, CCL24, CCL25, CCR1, CCR2, CCR3, CCR4, CCR5, CCR6, CCR7, CCR8, CCR9, CX3CL1, CX3CR1, CXCL1, CXCL2, CXCL3, CXCL5, CXCL6, CXCL10, CXCL11, CXCL12, CXCL13, CXCR4, GPR2, SCYE1, SDF2, XCL1, XCL2, XCR1, AMH, AMHR2, BMPR1A, BMPR1B, BMPR2, C19orf10 (IL27w), CER1, CSF1, CSF2, CSF3, DKFZp451J0118, FGF2, GFI1, IFNA1, IFNB1, IFNG, IGF1, IL1A, IL1B, IL1R1, IL1R2, IL2, IL2RA, IL2RB, IL2RG, IL3, IL4, IL4R, IL5, IL5RA, IL6, IL6R, IL6ST, IL7, IL8, IL8RA, IL8RB, IL9, IL9R, IL10, IL10RA, IL10RB, IL11, IL11RA, IL12A, IL12B, IL12RB1, IL12RB2, IL13, IL13RA1, IL13RA2, IL15, IL15RA, IL16, IL17, IL17R, IL18, IL18R1, IL19, IL20, KITLG, LEP, LTA, LTB, LTB4R, LTB4R2, LTBR, MIF, NPPB, PDGFB, TBX21, TDGF1, TGFA, TGFB1, TGFB1I1, TGFB2, TGFB3, TGFBI, TGFBR1, TGFBR2, TGFBR3, TH1L, TNF, TNFRSF1A, TNFRSF1B, TNFRSF7, TNFRSF8, TNFRSF9, TNFRSF11A, TNFRSF21, TNFSF4, TNFSF5, TNFSF6, TNFSF11, VEGF, ZFPM2, and RNF110 (ZNF144). In one aspect, DVD-Igs capable of binding one or more of the targets listed herein are provided.

2. Asthma

Allergic asthma is characterized by the presence of eosinophilia, goblet cell metaplasia, epithelial cell alterations, airway hyperreactivity (AHR), and Th2 and Th1 cytokine expression, as well as elevated serum IgE levels. It is now widely accepted that airway inflammation is the key factor underlying the pathogenesis of asthma, involving a complex interplay of inflammatory cells such as T cells, B cells, eosinophils, mast cells and macrophages, and of their secreted mediators including cytokines and chemokines. Corticosteroids are the most important anti-inflammatory treatment for asthma today, however their mechanism of action is non-specific and safety concerns exist, especially in the juvenile patient population. The development of more specific and targeted therapies is therefore warranted. There is increasing evidence that IL-13 in mice mimics many of the features of asthma, including AHR, mucus hypersecretion and airway fibrosis, independently of eosinophilic inflammation (Finotto et al., International Immunology (2005), 17(8), 993-1007; Padilla et al., Journal of Immunology (2005), 174(12), 8097-8105).

IL-13 has been implicated as having a pivotal role in causing pathological responses associated with asthma. The development of anti-IL-13 mAb therapy to reduce the effects of IL-13 in the lung is an exciting new approach that offers considerable promise as a novel treatment for asthma. However other mediators of differential immunological pathways are also involved in asthma pathogenesis, and blocking these mediators, in addition to IL-13, may offer additional therapeutic benefit. Such target pairs include, but are not limited to, IL-13 and a pro-inflammatory cytokine, such as tumor necrosis factor-α (TNF-α). TNF-α may amplify the inflammatory response in asthma and may be linked to disease severity (McDonnell, et al., Progress in Respiratory Research (2001), 31 (New Drugs for Asthma, Allergy and COPD), 247-250). This suggests that blocking both IL-13 and TNF-α may have beneficial effects, particularly in severe airway disease. In another embodiment the DVD-Ig of the invention binds the targets IL-13 and TNFα and is used for treating asthma.

Animal models such as OVA-induced asthma mouse model, where both inflammation and AHR can be assessed, are known in the art and may be used to determine the ability of various DVD-Ig molecules to treat asthma. Animal models for studying asthma are disclosed in Coffman, et al., Journal of Experimental Medicine (2005), 201(12), 1875-1879; Lloyd, et al., Advances in Immunology (2001), 77, 263-295; Boyce et al., Journal of Experimental Medicine (2005), 201 (12), 1869-1873; and Snibson, et al., Journal of the British Society for Allergy and Clinical Immunology (2005), 35(2), 146-52. In addition to routine safety assessments of these target pairs specific tests for the degree of immunosuppression may be warranted and helpful in selecting the best target pairs (see Luster et al., Toxicology (1994), 92(1-3), 229-43; Descotes, et al., Developments in biological standardization (1992), 77 99-102; Hart et al., Journal of Allergy and Clinical Immunology (2001), 108(2), 250-257).

Based on the rationale disclosed herein and using the same evaluation model for efficacy and safety other pairs of targets that DVD-Ig molecules can bind and be useful to treat asthma may be determined. In an embodiment, such targets include, but are not limited to, IL-13 and IL-1beta, since IL-1beta is also implicated in inflammatory response in asthma; IL-13 and cytokines and chemokines that are involved in inflammation, such as IL-13 and IL-9; IL-13 and IL-4; IL-13 and IL-5; IL-13 and IL-25; IL-13 and TARO; IL-13 and MDC; IL-13 and MIF; IL-13 and TGF-β; IL-13 and LHR agonist; IL-13 and CL25; IL-13 and SPRR2a; IL-13 and SPRR2b; and IL-13 and ADAM8. The present invention also provides DVD-Igs capable of binding one or more targets involved in asthma selected from the group consisting of CSF1 (MCSF), CSF2 (GM-CSF), CSF3 (GCSF), FGF2, IFNA1, IFNB1, IFNG, histamine and histamine receptors, IL1A, IL1B, IL2, IL3, IL4, IL5, IL6, IL7, IL8, IL9, IL10, IL11, IL12A, IL12B, IL13, IL14, IL15, IL16, IL17, IL18, IL19, KITLG, PDGFB, IL2RA, IL4R, IL5RA, IL8RA, IL8RB, IL12RB1, IL12RB2, IL13RA1, IL13RA2, IL18R1, TSLP, CCL1, CCL2, CCL3, CCL4, CCL5, CCL7, CCL8, CCL13, CCL17, CCL18, CCL19, CCL20, CCL22, CCL24, CX3CL1, CXCL1, CXCL2, CXCL3, XCL1, CCR2, CCR3, CCR4, CCR5, CCR6, CCR7, CCR8, CX3CR1, GPR2, XCR1, FOS, GATA3, JAK1, JAK3, STATE, TBX21, TGFB1, TNF, TNFSF6, YY1, CYSLTR1, FCER1A, FCER2, LTB4R, TB4R2, LTBR, and Chitinase.

3. Rheumatoid Arthritis

Rheumatoid arthritis (RA), a systemic disease, is characterized by a chronic inflammatory reaction in the synovium of joints and is associated with degeneration of cartilage and erosion of juxta-articular bone. Many pro-inflammatory cytokines including TNF, chemokines, and growth factors are expressed in diseased joints. Systemic administration of anti-TNF antibody or sTNFR fusion protein to mouse models of RA was shown to be anti-inflammatory and joint protective. Clinical investigations in which the activity of TNF in RA patients was blocked with intravenously administered infliximab (Harriman G, Harper L K, Schaible T F. 1999 Summary of clinical trials in rheumatoid arthritis using infliximab, an anti-TNFalpha treatment. Ann Rheum Dis 58 Suppl 1:I61-4), a chimeric anti-TNF mAb, has provided evidence that TNF regulates IL-6, IL-8, MCP-1, and VEGF production, recruitment of immune and inflammatory cells into joints, angiogenesis, and reduction of blood levels of matrix metalloproteinases-1 and -3. A better understanding of the inflammatory pathway in rheumatoid arthritis has led to identification of other therapeutic targets involved in rheumatoid arthritis. Promising treatments such as interleukin-6 antagonists (IL-6 receptor antibody MRA, developed by Chugai, Roche (see Nishimoto, Norihiro et al., Arthritis & Rheumatism (2004), 50(6), 1761-1769), CTLA4Ig (abatacept, Genovese Mc et al 2005 Abatacept for rheumatoid arthritis refractory to tumor necrosis factor alpha inhibition. N Engl J. Med. 353:1114-23), and anti-B cell therapy (rituximab, Okamoto H, Kamatani N. 2004 Rituximab for rheumatoid arthritis. N Engl J Med. 351:1909) have already been tested in randomized controlled trials over the past year. Other cytokines have been identified and have been shown to be of benefit in animal models, including interleukin-15 (therapeutic antibody HuMax-IL_15, AMG 714 see Baslund, Bo et al., Arthritis & Rheumatism (2005), 52(9), 2686-2692), interleukin-17, and interleukin-18, and clinical trials of these agents are currently under way. Dual-specific antibody therapy, combining anti-TNF and another mediator, has great potential in enhancing clinical efficacy and/or patient coverage. For example, blocking both TNF and VEGF can potentially eradicate inflammation and angiogenesis, both of which are involved in pathophysiology of RA. Blocking other pairs of targets involved in RA including, but not limited to, TNF and IL-18; TNF and IL-12; TNF and IL-23; TNF and IL-1beta; TNF and MIF; TNF and IL-17; TNF and IL-15 with specific DVD Igs is also contemplated. In addition to routine safety assessments of these target pairs, specific tests for the degree of immunosuppression may be warranted and helpful in selecting the best target pairs (see Luster et al., Toxicology (1994), 92(1-3), 229-43; Descotes, et al., Developments in biological standardization (1992), 77 99-102; Hart et al., Journal of Allergy and Clinical Immunology (2001), 108(2), 250-257). Whether a DVD Ig molecule will be useful for the treatment of rheumatoid arthritis can be assessed using pre-clinical animal RA models such as the collagen-induced arthritis mouse model. Other useful models are also well known in the art (see Brand D D., Comp Med. (2005) 55(2):114-22). Based on the cross-reactivity of the parental antibodies for human and mouse othologues (e.g., reactivity for human and mouse TNF, human and mouse IL-15 etc.) validation studies in the mouse CIA model may be conducted with "matched surrogate antibody" derived DVD-Ig molecules; briefly, a DVD-Ig based on two (or more) mouse target specific antibodies may be matched to the extent possible to the characteristics of the parental human or humanized antibodies used for human DVD-Ig construction (similar affinity, similar neutralization potency, similar half-life etc.).

4. SLE

The immunopathogenic hallmark of SLE is the polyclonal B cell activation, which leads to hyperglobulinemia, autoantibody production and immune complex formation. The fundamental abnormality appears to be the failure of T cells to suppress the forbidden B cell clones due to generalized T cell dysregulation. In addition, B and T-cell interaction is facilitated by several cytokines such as IL-10 as well as co-stimulatory molecules such as CD40 and CD40L, B7 and CD28 and CTLA-4, which initiate the second signal. These interactions together with impaired phagocytic clearance of immune complexes and apoptotic material, perpetuate the immune response with resultant tissue injury. The following targets may be involved in SLE and can potentially be used for DVD-Ig approach for therapeutic intervention: B cell targeted therapies: CD-20, CD-22, CD-19, CD28, CD4, CD80, HLA-DRA, IL10, IL2, IL4, TNFRSF5, TNFRSF6, TNFSF5, TNFSF6, BLR1, HDAC4, HDAC5, HDAC7A, HDAC9, ICOSL, IGBP1, MS4A1, RGS1, SLA2, CD81, IFNB1, IL10, TNFRSF5, TNFRSF7, TNFSF5, AICDA, BLNK, GALNAC4S-6ST, HDAC4, HDAC5, HDAC7A, HDAC9, IL10, IL11, IL4, INHA, INHBA, KLF6, TNFRSF7, CD28, CD38, CD69, CD80, CD83, CD86, DPP4, FCER2, IL2RA, TNFRSF8, TNFSF7, CD24, CD37, CD40, CD72, CD74, CD79A, CD79B, CR2, IL1R2, ITGA2, ITGA3, MS4A1, ST6GAL1, CD1C, CHST10, HLA-A, HLA-DRA, and NT5E; co-stimulatory signals: CTLA4 or B7.1/B7.2; inhibition of B cell survival: BlyS, BAFF; Complement inactivation: C5; Cytokine modulation: the key principle is that the net biologic response in any tissue is the result of a balance between local levels of proinflammatory or anti-inflammatory cytokines (see Sfikakis P P et al 2005 Curr Opin Rheumatol 17:550-7). SLE is considered to be a Th-2 driven disease with documented elevations in serum IL-4, IL-6, IL-10. DVD Igs capable of binding one or more targets selected from the group consisting of IL-4, IL-6, IL-10, IFN-α, and TNF-α are also contemplated. Combination of targets discussed herein will enhance therapeutic efficacy for SLE which can be tested in a number of lupus preclinical models (see Peng S L (2004) Methods Mol Med.; 102:227-72). Based on the cross-reactivity of the parental antibodies for human and mouse othologues (e.g., reactivity for human and mouse CD20, human and mouse Interferon alpha etc.) validation studies in a mouse lupus model may be conducted with "matched surrogate antibody" derived DVD-Ig molecules; briefly, a DVD-Ig based two (or more) mouse target specific antibodies may be matched to the extent possible to the characteristics of the parental human or humanized antibodies used for human DVD-Ig construction (similar affinity, similar neutralization potency, similar half-life etc.).

5. Multiple Sclerosis

Multiple sclerosis (MS) is a complex human autoimmune-type disease with a predominantly unknown etiology. Immunologic destruction of myelin basic protein (MBP) throughout the nervous system is the major pathology of multiple sclerosis. MS is a disease of complex pathologies, which involves infiltration by CD4+ and CD8+ T cells and of response within the central nervous system. Expression in the CNS of cytokines, reactive nitrogen species and costimulator molecules have all been described in MS. Of major consideration are immunological mechanisms that contribute to the development of autoimmunity. In particular, antigen expression, cytokine and leukocyte interactions, and regulatory T-cells, which help balance/modulate other T-cells such as Th1 and Th2 cells, are important areas for therapeutic target identification.

IL-12 is a proinflammatory cytokine that is produced by APC and promotes differentiation of Th1 effector cells. IL-12 is produced in the developing lesions of patients with MS as well as in EAE-affected animals. Previously it was shown that interference in IL-12 pathways effectively prevents EAE in rodents, and that in vivo neutralization of IL-12p40 using a anti-IL-12 mAb has beneficial effects in the myelin-induced EAE model in common marmosets.

TWEAK is a member of the TNF family, constitutively expressed in the central nervous system (CNS), with pro-inflammatory, proliferative or apoptotic effects depending upon cell types. Its receptor, Fn14, is expressed in CNS by endothelial cells, reactive astrocytes and neurons. TWEAK and Fn14 mRNA expression increased in spinal cord during experimental autoimmune encephalomyelitis (EAE). Anti-TWEAK antibody treatment in myelin oligodendrocyte glycoprotein (MOG) induced EAE in C57BL/6 mice resulted in a reduction of disease severity and leukocyte infiltration when mice were treated after the priming phase.

One aspect of the invention pertains to DVD Ig molecules capable of binding one or more, for example two, targets selected from the group consisting of IL-12, TWEAK, IL-23, CXCL13, CD40, CD40L, IL-18, VEGF, VLA-4, TNF, CD45RB, CD200, IFNgamma, GM-CSF, FGF, C5, CD52, and CCR2. An embodiment includes a dual-specific anti-IL-12/TWEAK DVD Ig as a therapeutic agent beneficial for the treatment of MS.

Several animal models for assessing the usefulness of the DVD molecules to treat MS are known in the art (see Steinman L, et al., (2005) Trends Immunol. 26(11):565-71; Lublin F D., et al., (1985) Springer Semin Immunopathol. 8(3):197-208; Genain C P, et al., (1997) J Mol Med. 75(3):187-97; Tuohy V K, et al., (1999) J Exp Med. 189(7):1033-42; Owens T, et al., (1995) Neurol Clin. 13(1):51-73; and 't Hart B A, et al., (2005) J Immunol 175(7):4761-8. Based on the cross-reactivity of the parental antibodies for human and animal species othologues (e.g., reactivity for human and mouse IL-12, human and mouse TWEAK etc.) validation studies in the mouse EAE model may be conducted with "matched surrogate antibody" derived DVD-Ig molecules; briefly, a DVD-Ig based on to (or more) mouse target specific antibodies may be matched to the extent possible to the characteristics of the parental human or humanized antibodies used for human DVD-Ig construction (similar affinity, similar neutralization potency, similar half-life etc.). The same concept applies to animal models in other non-rodent species, where a "matched surrogate antibody" derived DVD-Ig would be selected for the anticipated pharmacology and possibly safety studies. In addition to routine safety assessments of these target pairs specific tests for the degree of immunosuppression may be warranted and helpful in selecting the best target pairs (see Luster et al., Toxicology (1994), 92(1-3), 229-43; Descotes, et al., Developments in biological standardization (1992), 77 99-102; Jones R. 2000 Rovelizumab (ICOS Corp). IDrugs. 3(4):442-6).

6. Sepsis

The pathophysiology of sepsis is initiated by the outer membrane components of both gram-negative organisms (lipopolysaccharide [LPS], lipid A, endotoxin) and gram-positive organisms (lipoteichoic acid, peptidoglycan). These outer membrane components are able to bind to the CD14 receptor on the surface of monocytes. By virtue of the recently described toll-like receptors, a signal is then transmitted to the cell, leading to the eventual production of the proinflammatory cytokines tumor necrosis factor-alpha (TNF-alpha) and interleukin-1 (IL-1). Overwhelming inflammatory and immune responses are essential features of septic shock and play a central part in the pathogenesis of tissue damage, multiple organ failure, and death induced by sepsis. Cytokines, especially tumor necrosis factor (TNF) and interleukin (IL-1), have been shown to be critical mediators of septic shock. These cytokines have a direct toxic effect on tissues; they also activate phospholipase A2. These and other effects lead to increased concentrations of platelet-activating factor, promotion of nitric oxide synthase activity, promotion of tissue infiltration by neutrophils, and promotion of neutrophil activity.

The treatment of sepsis and septic shock remains a clinical conundrum, and recent prospective trials with biological response modifiers (i.e. anti-TNF, anti-MIF) aimed at the inflammatory response have shown only modest clinical benefit. Recently, interest has shifted toward therapies aimed at reversing the accompanying periods of immune suppression. Studies in experimental animals and critically ill patients have demonstrated that increased apoptosis of lymphoid organs and some parenchymal tissues contribute to this immune suppression, anergy, and organ system dysfunction. During sepsis syndromes, lymphocyte apoptosis can be triggered by the absence of IL-2 or by the release of glucocorticoids, granzymes, or the so-called 'death' cytokines: tumor necrosis factor alpha or Fas ligand. Apoptosis proceeds via auto-activation of cytosolic and/or mitochondrial caspases, which can be influenced by the pro- and anti-apoptotic members of the Bcl-2 family. In experimental animals, not only can treatment with inhibitors of apoptosis prevent lymphoid cell apoptosis; it may also improve outcome. Although clinical trials with anti-apoptotic agents remain distant due in large part to technical difficulties associated with their administration and tissue targeting, inhibition of lymphocyte apoptosis represents an attractive therapeutic target for the septic patient. Likewise, a dual-specific agent targeting both inflammatory mediator and a apoptotic mediator, may have added benefit. One aspect of the invention pertains to DVD Igs capable of binding one or more targets involved in sepsis, in an embodiment two targets, selected from the group consisting TNF, IL-1, MIF, IL-6, IL-8, IL-18, IL-12, IL-23, FasL, LPS, Toll-like receptors, TLR-4, tissue factor, MIP-2, ADORA2A, CASP1, CASP4, IL-10, IL-1B, NFKB1, PROC, TNFRSF1A, CSF3, CCR3, IL1RN, MIF, NFKB1, PTAFR, TLR2, TLR4, GPR44, HMOX1, midkine, IRAK1, NFKB2, SERPINA1, SERPINE1, and TREM1. The efficacy of such DVD Igs for sepsis can be assessed in preclinical animal models known in the art (see Buras J A, et al., (2005) Nat Rev Drug Discov. 4(10):854-65 and Calandra T, et al., (2000) Nat Med. 6(2):164-70).

7. Neurological Disorders 7.1. Neurodegenerative Diseases

Chronic neurodegenerative diseases are usually age-dependent diseases characterized by progressive loss of neuronal functions (neuronal cell death, demyelination), loss of mobility and loss of memory. Emerging knowledge of the mechanisms underlying chronic neurodegenerative diseases (e.g., Alzheimer's disease) show a complex etiology and a variety of factors have been recognized to contribute to their development and progression e.g., age, glycemic status, amyloid production and multimerization, accumulation of advanced glycation-end products (AGE) which bind to their receptor RAGE (receptor for AGE), increased brain oxidative stress, decreased cerebral blood flow, neuroinflammation including release of inflammatory cytokines and chemokines, neuronal dysfunction and microglial activation. Thus these chronic neurodegenerative diseases represent a complex interaction between multiple cell types and mediators. Treatment strategies for such diseases are limited and mostly constitute either blocking inflammatory processes with non-specific anti-inflammatory agents (e.g., corticosteroids, COX inhibitors) or agents to prevent neuron loss and/or synaptic functions. These treatments fail to stop disease progression. Recent studies suggest that more targeted therapies such as antibodies to soluble A-b peptide (including the A-b oligomeric forms) can not only help stop disease progression but may help maintain memory as well. These preliminary observations suggest that specific therapies targeting more than one disease mediator (e.g., A-b and a pro-inflammatory cytokine such as TNF) may provide even better therapeutic efficacy for chronic neurodegenerative diseases than observed with targeting a single disease mechanism (e.g., soluble A-balone) (see C. E. Shepherd, et al, Neurobiol Aging. 2005 Oct. 24; Nelson R B., Curr Pharm Des. 2005; 11:3335; William L. Klein; Neurochem Int. 2002; 41:345; Michelle C Janelsins, et al., J. Neuroinflammation. 2005; 2:23; Soloman B., Curr Alzheimer Res. 2004; 1:149; Igor Klyubin, et al., Nat. Med. 2005; 11:556-61; Arancio O, et al., EMBO Journal (2004) 1-10; Bornemann K D, et al., Am J. Pathol. 2001; 158:63; Deane R, et al., Nat. Med. 2003; 9:907-13; and Eliezer Masliah, et al., Neuron. 2005; 46:857).

The DVD-Ig molecules of the invention can bind one or more targets involved in Chronic neurodegenerative diseases such as Alzheimers. Such targets include, but are not limited to, any mediator, soluble or cell surface, implicated in AD pathogenesis e.g. AGE (S100 A, amphoterin), pro-inflammatory cytokines (e.g., IL-1), chemokines (e.g., MCP 1), molecules that inhibit nerve regeneration (e.g., Nogo, RGM A), molecules that enhance neurite growth (neurotrophins). The efficacy of DVD-Ig molecules can be validated in pre-clinical animal models such as the transgenic mice that over-express amyloid precursor protein or RAGE and develop Alzheimer's disease-like symptoms. In addition, DVD-Ig molecules can be constructed and tested for efficacy in the animal models and the best therapeutic DVD-Ig can be selected for testing in human patients. DVD-Ig molecules can also be employed for treatment of other neurodegenerative diseases such as Parkinson's disease. Alpha-Synuclein is involved in Parkinson's pathology. A DVD-Ig capable of targeting alpha-synuclein and inflammatory mediators such as TNF, IL-1, MCP-1 can prove effective therapy for Parkinson's disease and are contemplated in the invention.

7.2 Neuronal Regeneration and Spinal Cord Injury

Despite an increase in knowledge of the pathologic mechanisms, spinal cord injury (SCI) is still a devastating condition and represents a medical indication characterized by a high medical need. Most spinal cord injuries are contusion or compression injuries and the primary injury is usually followed by secondary injury mechanisms (inflammatory mediators e.g., cytokines and chemokines) that worsen the initial injury and result in significant enlargement of the lesion area, sometimes more than 10-fold. These primary and secondary mechanisms in SCI are very similar to those in brain injury caused by other means e.g., stroke. No satisfying treatment exists and high dose bolus injection of methylprednisolone (MP) is the only used therapy within a narrow time window of 8 h post injury. This treatment, however, is only intended to prevent secondary injury without causing any significant functional recovery. It is heavily critisized for the lack of unequivocal efficacy and severe adverse effects, like immunosuppression with subsequent infections and severe histopathological muscle alterations. No other drugs, biologics or small molecules, stimulating the endogenous regenerative potential are approved, but promising treatment principles and drug candidates have shown efficacy in animal models of SCI in recent years. To a large extent the lack of functional recovery in human SCI is caused by factors inhibiting neurite growth, at lesion sites, in scar tissue, in myelin as well as on injury-associated cells. Such factors are the myelin-associated proteins NogoA, OMgp and MAG, RGM A, the scar-associated CSPG (Chondroitin Sulfate Proteoglycans) and inhibitory factors on reactive astrocytes (some semaphorins and ephrins). However, at the lesion site not only growth inhibitory molecules are found but also neurite growth stimulating factors like neurotrophins, laminin, L1 and others. This ensemble of neurite growth inhibitory and growth promoting molecules may explain that blocking single factors, like NogoA or RGM A, resulted in significant functional recovery in rodent SCI models, because a reduction of the inhibitory influences could shift the balance from growth inhibition to growth promotion. However, recoveries observed with blocking a single neurite outgrowth inhibitory molecule were not complete. To achieve faster and more pronounced recoveries either blocking two neurite outgrowth inhibitory molecules e.g. Nogo and RGM A, or blocking an neurite outgrowth inhibitory molecule and enhancing functions of a neurite outgrowth enhancing molecule e.g. Nogo and neurotrophins, or blocking a neurite outgrowth inhibitory molecule e.g., Nogo and a pro-inflammatory molecule e.g., TNF, may be desirable (see McGee A W, et al., Trends Neurosci. 2003; 26:193; Marco Domeniconi, et al., J Neurol Sci. 2005; 233:43; Milan Makwanal, et al., FEBS J. 2005; 272: 2628; Barry J. Dickson, Science. 2002; 298:1959; Felicia Yu Hsuan Teng, et al., J Neurosci Res. 2005; 79:273; Tara Karnezis, et al., Nature Neuroscience 2004; 7, 736; Gang Xu, et al., J. Neurochem. 2004; 91; 1018).

In one aspect, DVD-Igs capable of binding target pairs such as NgR and RGM A; NogoA and RGM A; MAG and RGM A; OMgp and RGM A; RGM A and RGM B; CSPGs and RGM A; aggrecan, midkine, neurocan, versican, phosphacan, Te38 and TNF-α; Aβ globulomer-specific antibodies combined with antibodies promoting dendrite & axon sprouting are provided. Dendrite pathology is a very early sign of AD and it is known that NOGO A restricts dendrite growth. One can combine such type of ab with any of the SCI-candidate (myelin-proteins) Ab. Other DVD-Ig targets may include any combination of NgR-p75, NgR-Troy, NgR-Nogo66 (Nogo), NgR-Lingo, Lingo-Troy, Lingo-p75, MAG or Omgp. Additionally, targets may also include any mediator, soluble or cell surface, implicated in inhibition of neurite e.g. Nogo, Ompg, MAG, RGM A, semaphorins, ephrins, soluble A-b, pro-inflammatory cytokines (e.g., IL-1), chemokines (e.g., MIP 1a), molecules that inhibit nerve regeneration. The efficacy of anti-nogo/anti-RGM A or similar DVD-Ig molecules can be validated in pre-clinical animal models of spinal cord injury. In addition, these DVD-Ig molecules can be constructed and tested for efficacy in the animal models and the best therapeutic DVD-Ig can be selected for testing in human patients. In addition, DVD-Ig molecules can be constructed that target two distinct ligand binding sites on a single receptor e.g., Nogo receptor which binds three ligand Nogo, Ompg, and MAG and RAGE that binds A-b and S100 A. Furthermore, neurite outgrowth inhibitors e.g., nogo and nogo receptor, also play a role in preventing nerve regeneration in immunological diseases like multiple sclerosis. Inhibition of nogo-nogo receptor interaction has been shown to enhance recovery in animal models of multiple sclerosis. Therefore, DVD-Ig molecules that can block the function of one immune mediator e.g. a cytokine like IL-12 and a neurite outgrowth inhibitor molecule e.g. nogo or RGM may offer faster and greater efficacy than blocking either an immune or an neurite outgrowth inhibitor molecule alone.

8. Oncological Disorders

Monoclonal antibody therapy has emerged as an important therapeutic modality for cancer (von Mehren M, et al 2003 Monoclonal antibody therapy for cancer. Annu Rev Med.; 54:343-69). Antibodies may exert antitumor effects by inducing apoptosis, redirected cytotoxicity, interfering with ligand-receptor interactions, or preventing the expression of proteins that are critical to the neoplastic phenotype. In addition, antibodies can target components of the tumor microenvironment, perturbing vital structures such as the formation of tumor-associated vasculature. Antibodies can also target receptors whose ligands are growth factors, such as the epidermal growth factor receptor. The antibody thus inhibits natural ligands that stimulate cell growth from binding to targeted tumor cells. Alternatively, antibodies may induce an anti-idiotype network, complement-mediated cytotoxicity, or antibody-dependent cellular cytotoxicity (ADCC). The use of dual-specific antibody that targets two separate tumor mediators will likely give additional benefit compared to a mono-specific therapy. DVD Igs capable of binding the following pairs of targets to treat oncological disease are also contemplated: IGF1 and IGF2; IGF1/2 and HER-2; VEGFR and EGFR; CD20 and CD3; CD138 and CD20; CD38 and CD20; CD38 and CD138; CD40 and CD20; CD138 and CD40; CD38 and CD40; CD-20 and CD-19; CD-20 and EGFR; CD-20 and CD-80; CD-20 and CD-22; CD-3 and HER-2; CD-3 and CD-19; EGFR and HER-2; EGFR and CD-3; EGFR and IGF1,2; EGFR and IGF1R; EGFR and RON; EGFR and HGF; EGFR and c-MET; HER-2 and IGF1,2; HER-2 and IGF1R; RON and HGF; VEGF and EGFR; VEGF and HER-2; VEGF and CD-20; VEGF and IGF1,2; VEGF and DLL4; VEGF and HGF; VEGF and RON; VEGF and NRP1; CD20 and CD3; VEGF and PLGF; DLL4 and PLGF; ErbB3 and EGFR; HGF and ErbB3, HER-2 and ErbB3; c-Met and ErbB3; HER-2 and PLGF; HER-2 and HER-2.

In another embodiment, a DVD of the invention is capable of binding VEGF and phosphatidylserine; VEGF and ErbB3; VEGF and PLGF; VEGF and ROBO4; VEGF and BSG2; VEGF and CDCP1; VEGF and ANPEP; VEGF and c-MET; HER-2 and ERB3; HER-2 and BSG2; HER-2 and CDCP1; HER-2 and ANPEP; EGFR and CD64; EGFR and BSG2; EGFR and CDCP1; EGFR and ANPEP; IGF1R and PDGFR; IGF1R and VEGF; IGF1R and CD20; CD20 and CD74; CD20 and CD30; CD20 and DR4; CD20 and VEGFR2; CD20 and CD52; CD20 and CD4; HGF and c-MET; HGF and NRP1; HGF and phosphatidylserine; ErbB3 and IGF1R; ErbB3 and IGF1,2; c-Met and Her-2; c-Met and NRP1; c-Met and IGF1R; IGF1,2 and PDGFR; IGF1,2 and CD20; IGF1,2 and IGF1R; IGF2 and EGFR; IGF2 and HER2; IGF2 and CD20; IGF2 and VEGF; IGF2 and IGF1R; IGF1 and IGF2; PDGFRa and VEGFR2; PDGFRa and PLGF; PDGFRa and VEGF; PDGFRa and c-Met; PDGFRa and EGFR; PDGFRb and VEGFR2; PDGFRb and c-Met; PDGFRb and EGFR; RON and c-Met; RON and MTSP1; RON and MSP; RON and CDCP1; VGFR1 and PLGF; VGFR1 and RON; VGFR1 and EGFR; VEGFR2 and PLGF; VEGFR2 and NRP1; VEGFR2 and RON; VEGFR2 and DLL4; VEGFR2 and EGFR; VEGFR2 and ROBO4; VEGFR2 and CD55; LPA and S1P; EPHB2 and RON; CTLA4 and VEGF; CD3 and EPCAM; CD40 and IL6; CD40 and IGF; CD40 and CD56; CD40 and CD70; CD40 and VEGFR1; CD40 and DR5; CD40 and DR4; CD40 and APRIL; CD40 and BCMA; CD40 and RANKL; CD28 and MAPG; CD80 and CD40; CD80 and CD30; CD80 and CD33; CD80 and CD74; CD80 and CD2; CD80 and CD3; CD80 and CD19; CD80 and CD4; CD80 and CD52; CD80 and VEGF; CD80 and DR5; CD80 and VEGFR2; CD22 and CD20; CD22 and CD80; CD22 and CD40; CD22 and CD23; CD22 and CD33; CD22 and CD74; CD22 and CD19; CD22 and DR5; CD22 and DR4; CD22 and VEGF; CD22 and CD52; CD30 and CD20; CD30 and CD22; CD30 and CD23; CD30 and CD40; CD30 and VEGF; CD30 and CD74; CD30 and CD19; CD30 and DR5; CD30 and DR4; CD30 and VEGFR2; CD30 and CD52; CD30 and CD4; CD138 and RANKL; CD33 and FTL3; CD33 and VEGF; CD33 and VEGFR2; CD33 and CD44; CD33 and DR4; CD33 and DR5; DR4 and CD137; DR4 and IGF1,2; DR4 and IGF1R; DR4 and DR5; DR5 and CD40; DR5 and CD137; DR5 and CD20; DR5 and EGFR; DR5 and IGF1,2; DR5 and IGFR, DR5 and HER-2, EGFR and DLL4. Other target combinations include one or more members of the EGF/erb-2/erb-3 family. Other targets (one or more) involved in oncological diseases that DVD Igs may bind include, but are not limited to those selected from the group consisting of: CD52, CD20, CD19, CD3, CD4, CD8, BMP6, IL12A, IL1A, IL1B, IL2, IL24, INHA, TNF, TNFSF10, BMP6, EGF, FGF1, FGF10, FGF11, FGF12, FGF13, FGF14, FGF16, FGF17, FGF18, FGF19, FGF2, FGF20, FGF21, FGF22, FGF23, FGF3, FGF4, FGF5, FGF6, FGF7, FGF8, FGF9, GRP, IGF1, IGF2, IL12A, IL1A, IL1B, IL2, INHA, TGFA, TGFB1, TGFB2, TGFB3, VEGF, CDK2, FGF10, FGF18, FGF2, FGF4, FGF7, IGF1R, IL2, BCL2, CD164, CDKN1A, CDKN1B, CDKN1C, CDKN2A, CDKN2B, CDKN2C, CDKN3, GNRH1, IGFBP6, IL1A, IL1B, ODZ1, PAWR, PLG, TGFB1I1, AR, BRCA1, CDK3, CDK4, CDK5, CDK6, CDK7, CDK9, E2F1, EGFR, ENO1, ERBB2, ESR1, ESR2, IGFBP3, IGFBP6, IL2, INSL4, MYC, NOX5, NR6A1, PAP, PCNA, PRKCQ, PRKD1, PRL, TP53, FGF22, FGF23, FGF9, IGFBP3, IL2, INHA, KLK6, TP53, CHGB, GNRH1, IGF1, IGF2, INHA, INSL3, INSL4, PRL, KLK6, SHBG, NR1D1, NR1H3, NR113, NR2F6, NR4A3, ESR1, ESR2, NROB1, NROB2, NR1D2, NR1H2, NR1H4, NR112, NR2C1, NR2C2, NR2E1, NR2E3, NR2F1, NR2F2, NR3C1, NR3C2, NR4A1, NR4A2, NR5A1, NR5A2, NR6A1, PGR, RARB, FGF1, FGF2, FGF6, KLK3, KRT1, APOC1, BRCA1, CHGA, CHGB, CLU, COL1A1, COL6A1, EGF, ERBB2, ERK8, FGF1, FGF10, FGF11, FGF13, FGF14, FGF16, FGF17, FGF18, FGF2, FGF20, FGF21, FGF22, FGF23, FGF3, FGF4, FGF5, FGF6, FGF7, FGF8, FGF9, GNRH1, IGF1, IGF2, IGFBP3, IGFBP6, IL12A, IL1A, IL1B, IL2, IL24, INHA, INSL3, INSL4, KLK10, KLK12, KLK13, KLK14, KLK15, KLK3, KLK4, KLK5, KLK6, KLK9, MMP2, MMP9, MSMB, NTN4, ODZ1, PAP, PLAU, PRL, PSAP, SERPINA3, SHBG, TGFA, TIMP3, CD44, CDH1, CDH10, CDH19, CDH20, CDH7, CDH9, CDH1, CDH10, CDH13, CDH18, CDH19, CDH20, CDH7, CDH8, CDH9, ROBO2, CD44, ILK, ITGA1, APC, CD164, COL6A1, MTSS1, PAP, TGFB1I1, AGR2, AIG1, AKAP1, AKAP2, CANT1, CAV1, CDH12, CLDN3, CLN3, CYB5, CYC1, DAB21P, DES, DNCL1, ELAC2, ENO2, ENO3, FASN, FLJ12584, FLJ25530, GAGEB1, GAGEC1, GGT1, GSTP1, HIP1, HUMCYT2A, IL29, K6HF, KAI1, KRT2A, MIB1, PART1, PATE, PCA3, PIAS2, PIK3CG, PPID, PR1, PSCA, SLC2A2, SLC33A1, SLC43A1, STEAP, STEAP2, TPM1, TPM2, TRPC6, ANGPT1, ANGPT2, ANPEP, ECGF1, EREG, FGF1, FGF2, FIGF, FLT1, JAG1, KDR, LAMA5, NRP1, NRP2, PGF, PLXDC1, STAB1, VEGF, VEGFC, ANGPTL3, BAI1, COL4A3, IL8, LAMA5, NRP1, NRP2, STAB1, ANGPTL4, PECAM1, PF4, PROK2, SERPINF1, TNFAIP2, CCL11, CCL2, CXCL1, CXCL10, CXCL3, CXCL5, CXCL6, CXCL9, IFNA1, IFNB1, IFNG, IL1B, IL6, MDK, EDG1, EFNA1, EFNA3, EFNB2, EGF, EPHB4, FGFR3, HGF, IGF1, ITGB3, PDGFA, TEK, TGFA, TGFB1, TGFB2, TGFBR1, CCL2, CDH5, COL18A1, EDG1, ENG, ITGAV, ITGB3, THBS1, THBS2, BAD, BAG1, BCL2, CCNA1, CCNA2, CCND1, CCNE1, CCNE2, CDH1 (E-cadherin), CDKN1B (p27Kip1), CDKN2A (p161NK4a), COL6A1, CTNNB1 (b-catenin), CTSB (cathepsin B), ERBB2 (Her-2), ESR1, ESR2, F3 (TF), FOSL1 (FRA-1), GATA3, GSN (Gelsolin), IGFBP2, IL2RA, IL6, IL6R, IL6ST (glycoprotein 130), ITGA6 (a6 integrin), JUN, KLK5, KRT19, MAP2K7 (c-Jun), MKI67 (Ki-67), NGFB (NGF), NGFR, NME1 (NM23A), PGR, PLAU (uPA), PTEN, SERPINB5 (maspin), SERPINE1 (PAI-1), TGFA, THBS1 (thrombospondin-1), TIE (Tie-1), TNFRSF6 (Fas), TNFSF6 (FasL), TOP2A (topoisomerase Ea), TP53, AZGP1 (zinc-a-glycoprotein), BPAG1 (plectin), CDKN1A (p21Wap1/Cip1), CLDN7 (claudin-7), CLU (clusterin), ERBB2 (Her-2), FGF1, FLRT1 (fibronectin), GABRP (GABAa), GNAS1, ID2, ITGA6 (a6 integrin), ITGB4 (b 4 integrin), KLF5 (GC Box BP), KRT19 (Keratin 19), KRTHB6 (hair-specific type II keratin), MACMARCKS, MT3 (metallothionectin-III), MUC1 (mucin), PTGS2 (COX-2), RAC2 (p21Rac2), S100A2, SCGB1D2 (lipophilin B), SCGB2A1 (mammaglobin 2), SCGB2A2 (mammaglobin 1), SPRR1B (Sprl), THBS1, THBS2, THBS4, and TNFAIP2 (B94), RON, c-Met, CD64, DLL4, PLGF, CTLA4, phosphatidylserine, ROBO4, CD80, CD22, CD40, CD23, CD28, CD80, CD55, CD38, CD70, CD74, CD30, CD138, CD56, CD33, CD2, CD137, DR4, DR5, RANKL, VEGFR2, PDGFR, VEGFR1, MTSP1, MSP, EPHB2, EPHA1, EPHA2, EpCAM, PGE2, NKG2D, LPA, SIP, APRIL, BCMA, MAPG, FLT3, PDGFR alpha, PDGFR beta, ROR1, PSMA, PSCA, SCD1, and CD59.

IV. Pharmaceutical Compositions

The invention also provides pharmaceutical compositions comprising a binding protein, of the invention and a pharmaceutically acceptable carrier. The pharmaceutical compositions comprising binding proteins of the invention are for use in, but not limited to, diagnosing, detecting, or monitoring a disorder, in preventing, treating, managing, or ameliorating of a disorder or one or more symptoms thereof, and/or in research. In a specific embodiment, a composition comprises one or more binding proteins of the invention. In another embodiment, the pharmaceutical composition comprises one or more binding proteins of the invention and one or more prophylactic or therapeutic agents other than binding proteins of the invention for treating a disorder. In an embodiment, the prophylactic or therapeutic agents known to be useful for or having been or currently being used in the prevention, treatment, management, or amelioration of a disorder or one or more symptoms thereof. In accordance with these embodiments, the composition may further comprise of a carrier, diluent or excipient.

The binding proteins of the invention can be incorporated into pharmaceutical compositions suitable for administration to a subject. Typically, the pharmaceutical composition comprises a binding protein of the invention and a pharmaceutically acceptable carrier. As used herein, "pharmaceutically acceptable carrier" includes any and all solvents, dispersion media, coatings, antibacterial and antifungal agents, isotonic and absorption delaying agents, and the like that are physiologically compatible. Examples of pharmaceutically acceptable carriers include one or more of water, saline, phosphate buffered saline, dextrose, glycerol, ethanol and the like, as well as combinations thereof. In some embodiments, isotonic agents, for example, sugars, polyalcohols such as mannitol, sorbitol, or sodium chloride, are included in the composition. Pharmaceutically acceptable carriers may further comprise minor amounts of auxiliary substances such as wetting or emulsifying agents, preservatives or buffers, which enhance the shelf life or effectiveness of the antibody or antibody portion.

Various delivery systems are known and can be used to administer one or more antibodies of the invention or the combination of one or more antibodies of the invention and a prophylactic agent or therapeutic agent useful for preventing, managing, treating, or ameliorating a disorder or one or more symptoms thereof, e.g., encapsulation in liposomes, microparticles, microcapsules, recombinant cells capable of expressing the antibody or antibody fragment, receptor-mediated endocytosis (see, e.g., Wu and Wu, J. Biol. Chem. 262:4429-4432 (1987)), construction of a nucleic acid as part of a retroviral or other vector, etc. Methods of administering a prophylactic or therapeutic agent of the invention include, but are not limited to, parenteral administration (e.g., intradermal, intramuscular, intraperitoneal, intravenous and subcutaneous), epidurala administration, intratumoral administration, and mucosal administration (e.g., intranasal and oral routes). In addition, pulmonary administration can be employed, e.g., by use of an inhaler or nebulizer, and formulation with an aerosolizing agent. See, e.g., U.S. Pat. Nos. 6,019,968; 5,985,320; 5,985,309; 5,934,272; 5,874,064; 5,855,913; 5,290,540; and 4,880,078; and PCT Publication Nos. WO 92/19244; WO 97/32572; WO 97/44013; WO 98/31346; and WO 99/66903, each of which is incorporated herein by reference their entireties. In one embodiment, a binding protein of the invention, combination therapy, or a composition of the invention is administered using Alkermes AIR® pulmonary drug delivery technology (Alkermes, Inc., Cambridge, Mass.). In a specific embodiment, prophylactic or therapeutic agents of the invention are administered intramuscularly, intravenously, intratumorally, orally, intranasally, pulmonary, or subcutaneously. The prophylactic or therapeutic agents may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

In an embodiment, specific binding of antibody-coupled carbon nanotubes (CNTs) to tumor cells in vitro, followed by their highly specific ablation with near-infrared (NIR) light can be used to target tumor cells. For example, biotinylated polar lipids can be used to prepare stable, biocompatible, noncytotoxic CNT dispersions that are then attached to one or two different neutralite avidin-derivatized DVD-Igs directed against one or more tumor antigens (e.g., CD22) (Chakravarty, P. et al. (2008) Proc. Natl. Acad. Sci. USA 105:8697-8702.

In a specific embodiment, it may be desirable to administer the prophylactic or therapeutic agents of the invention locally to the area in need of treatment; this may be achieved by, for example, and not by way of limitation, local infusion, by injection, or by means of an implant, said implant being of a porous or non-porous material, including membranes and matrices, such as sialastic membranes, polymers, fibrous matrices (e.g., Tissuel®), or collagen matrices. In one embodiment, an effective amount of one or more antibodies of the invention antagonists is administered locally to the affected area to a subject to prevent, treat, manage, and/or ameliorate a disorder or a symptom thereof. In another embodiment, an effective amount of one or more antibodies of the invention is administered locally to the affected area in combination with an effective amount of one or more therapies (e.g., one or more prophylactic or therapeutic agents) other than a binding protein of the invention of a subject to prevent, treat, manage, and/or ameliorate a disorder or one or more symptoms thereof.

In another embodiment, the prophylactic or therapeutic agent can be delivered in a controlled release or sustained release system. In one embodiment, a pump may be used to achieve controlled or sustained release (see Langer, supra; Sefton, 1987, CRC Crit. Ref Biomed. Eng. 14:20; Buchwald et al., 1980, Surgery 88:507; Saudek et al., 1989, N. Engl. J. Med. 321:574). In another embodiment, polymeric materials can be used to achieve controlled or sustained release of the therapies of the invention (see e.g., Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, 1983, J., Macromol. Sci. Rev. Macromol. Chem. 23:61; see also Levy et al., 1985, Science 228:190; During et al., 1989, Ann. Neurol. 25:351; Howard et al., 1989, J. Neurosurg. 7 1:105); U.S. Pat. No. 5,679,377; U.S. Pat. No. 5,916,597; U.S. Pat. No. 5,912, 015; U.S. Pat. No. 5,989,463; U.S. Pat. No. 5,128,326; PCT Publication No. WO 99/15154; and PCT Publication No. WO 99/20253. Examples of polymers used in sustained release formulations include, but are not limited to, poly(2-hydroxy ethyl methacrylate), poly(methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. In an embodiment, the polymer used in a sustained release formulation is inert, free of leachable impurities, stable on storage, sterile, and biodegradable. In yet another embodiment, a controlled or sustained release system can be placed in proximity of the prophylactic or therapeutic target, thus requiring only a fraction of the systemic dose (see, e.g., Goodson, in Medical Applications of Controlled Release, supra, vol. 2, pp. 115-138 (1984)).

Controlled release systems are discussed in the review by Langer (1990, Science 249:1527-1533). Any technique known to one of skill in the art can be used to produce sustained release formulations comprising one or more therapeutic agents of the invention. See, e.g., U.S. Pat. No. 4,526, 938, PCT publication WO 91/05548, PCT publication WO 96/20698, Ning et al., 1996, "Intratumoral Radioimmunotherapy of a Human Colon Cancer Xenograft Using a Sustained-Release Gel," Radiotherapy &Oncology 39:179-189, Song et al., 1995, "Antibody Mediated Lung Targeting of Long-Circulating Emulsions," PDA Journal of Pharmaceutical Science &Technology 50:372-397, Cleek et al., 1997, "Biodegradable Polymeric Carriers for a bFGF Antibody for Cardiovascular Application," Pro. Int'l. Symp. Control. Rel. Bioact. Mater. 24:853-854, and Lam et al., 1997, "Microencapsulation of Recombinant Humanized Monoclonal Antibody for Local Delivery," Proc. Int'l. Symp. Control Rel. Bioact. Mater. 24:759-760, each of which is incorporated herein by reference in their entireties.

In a specific embodiment, where the composition of the invention is a nucleic acid encoding a prophylactic or therapeutic agent, the nucleic acid can be administered in vivo to promote expression of its encoded prophylactic or therapeutic agent, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, Dupont), or coating with lipids or cell-surface receptors or transfecting agents, or by administering it in linkage to a homeobox-like peptide which is known to enter the nucleus (see, e.g., Joliot et al., 1991, Proc. Natl. Acad. Sci. USA 88:1864-1868). Alternatively, a nucleic acid can be introduced intracellularly and incorporated within host cell DNA for expression by homologous recombination.

A pharmaceutical composition of the invention is formulated to be compatible with its intended route of administration. Examples of routes of administration include, but are not limited to, parenteral, e.g., intravenous, intradermal, subcutaneous, oral, intranasal (e.g., inhalation), transdermal (e.g., topical), transmucosal, and rectal administration. In a specific embodiment, the composition is formulated in accordance with routine procedures as a pharmaceutical composition adapted for intravenous, subcutaneous, intramuscular, oral, intranasal, or topical administration to human beings. Typically, compositions for intravenous administration are solutions in sterile isotonic aqueous buffer. Where necessary, the composition may also include a solubilizing agent and a local anesthetic such as lignocamne to ease pain at the site of the injection.

If the compositions of the invention are to be administered topically, the compositions can be formulated in the form of an ointment, cream, transdermal patch, lotion, gel, shampoo, spray, aerosol, solution, emulsion, or other form well-known to one of skill in the art. See, e.g., Remington's Pharmaceutical Sciences and Introduction to Pharmaceutical Dosage Forms, 19th ed., Mack Pub. Co., Easton, Pa. (1995). In an embodiment, for non-sprayable topical dosage forms, viscous to semi-solid or solid forms comprising a carrier or one or more excipients compatible with topical application and having a dynamic viscosity greater than water are employed. Suitable formulations include, without limitation, solutions, suspensions, emulsions, creams, ointments, powders, liniments, salves, and the like, which are, if desired, sterilized or mixed with auxiliary agents (e.g., preservatives, stabilizers, wetting agents, buffers, or salts) for influencing various properties, such as, for example, osmotic pressure. Other suitable topical dosage forms include sprayable aerosol preparations wherein the active ingredient, in an embodiment, in combination with a solid or liquid inert carrier, is packaged in a mixture with a pressurized volatile (e.g., a gaseous propellant, such as freon) or in a squeeze bottle. Moisturizers or humectants can also be added to pharmaceutical compositions and dosage forms if desired. Examples of such additional ingredients are well-known in the art.

If the method of the invention comprises intranasal administration of a composition, the composition can be formulated in an aerosol form, spray, mist or in the form of drops. In particular, prophylactic or therapeutic agents for use according to the present invention can be conveniently delivered in the form of an aerosol spray presentation from pressurized packs or a nebuliser, with the use of a suitable propellant (e.g., dichlorodifluoromethane, trichlorofluoromethane, dichlorotetrafluoroethane, carbon dioxide or other suitable gas). In the case of a pressurized aerosol the dosage unit may be determined by providing a valve to deliver a metered amount. Capsules and cartridges (composed of, e.g., gelatin) for use in an inhaler or insufflator may be formulated containing a powder mix of the compound and a suitable powder base such as lactose or starch.

If the method of the invention comprises oral administration, compositions can be formulated orally in the form of tablets, capsules, cachets, gelcaps, solutions, suspensions, and the like. Tablets or capsules can be prepared by conventional means with pharmaceutically acceptable excipients such as binding agents (e.g., pregelatinised maize starch, polyvinylpyrrolidone, or hydroxypropyl methylcellulose); fillers (e.g., lactose, microcrystalline cellulose, or calcium hydrogen phosphate); lubricants (e.g., magnesium stearate, talc, or silica); disintegrants (e.g., potato starch or sodium starch glycolate); or wetting agents (e.g., sodium lauryl sulphate). The tablets may be coated by methods well-known in the art. Liquid preparations for oral administration may take the form of, but not limited to, solutions, syrups or suspensions, or they may be presented as a dry product for constitution with water or other suitable vehicle before use. Such liquid preparations may be prepared by conventional means with pharmaceutically acceptable additives such as suspending agents (e.g., sorbitol syrup, cellulose derivatives, or hydrogenated edible fats); emulsifying agents (e.g., lecithin or acacia); non-aqueous vehicles (e.g., almond oil, oily esters, ethyl alcohol, or fractionated vegetable oils); and preservatives (e.g., methyl or propyl-p-hydroxybenzoates or sorbic acid). The preparations may also contain buffer salts, flavoring, coloring, and sweetening agents as appropriate. Preparations for oral administration may be suitably formulated for slow release, controlled release, or sustained release of a prophylactic or therapeutic agent(s).

The method of the invention may comprise pulmonary administration, e.g., by use of an inhaler or nebulizer, of a composition formulated with an aerosolizing agent. See, e.g., U.S. Pat. Nos. 6,019,968; 5,985,320; 5,985,309; 5,934,272; 5,874,064; 5,855,913; 5,290,540; and 4,880,078; and PCT Publication Nos. WO 92/19244; WO 97/32572; WO 97/44013; WO 98/31346; and WO 99/66903, each of which is incorporated herein by reference their entireties. In a specific embodiment, a binding protein of the invention, combination therapy, and/or composition of the invention is administered using Alkermes AIR® pulmonary drug delivery technology (Alkermes, Inc., Cambridge, Mass.).

The method of the invention may comprise administration of a composition formulated for parenteral administration by injection (e.g., by bolus injection or continuous infusion). Formulations for injection may be presented in unit dosage form (e.g., in ampoules or in multi-dose containers) with an added preservative. The compositions may take such forms as suspensions, solutions or emulsions in oily or aqueous vehicles, and may contain formulatory agents such as suspending, stabilizing and/or dispersing agents. Alternatively, the active ingredient may be in powder form for constitution with a suitable vehicle (e.g., sterile pyrogen-free water) before use.

The methods of the invention may additionally comprise of administration of compositions formulated as depot preparations. Such long acting formulations may be administered by implantation (e.g., subcutaneously or intramuscularly) or by intramuscular injection. Thus, for example, the compositions may be formulated with suitable polymeric or hydrophobic materials (e.g., as an emulsion in an acceptable oil) or ion exchange resins, or as sparingly soluble derivatives (e.g., as a sparingly soluble salt).

The methods of the invention encompass administration of compositions formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

Generally, the ingredients of compositions are supplied either separately or mixed together in unit dosage form, for example, as a dry lyophilized powder or water free concentrate in a hermetically sealed container such as an ampoule or sachette indicating the quantity of active agent. Where the mode of administration is infusion, composition can be dispensed with an infusion bottle containing sterile pharmaceutical grade water or saline. Where the mode of administration is by injection, an ampoule of sterile water for injection or saline can be provided so that the ingredients may be mixed prior to administration.

In particular, the invention also provides that one or more of the prophylactic or therapeutic agents, or pharmaceutical compositions of the invention is packaged in a hermetically sealed container such as an ampoule or sachette indicating the quantity of the agent. In one embodiment, one or more of the prophylactic or therapeutic agents, or pharmaceutical compositions of the invention is supplied as a dry sterilized lyophilized powder or water free concentrate in a hermetically sealed container and can be reconstituted (e.g., with water or saline) to the appropriate concentration for administration to a subject. In an embodiment, one or more of the prophylactic or therapeutic agents or pharmaceutical compositions of the invention is supplied as a dry sterile lyophilized powder in a hermetically sealed container at a unit dosage of at least 5 mg, at least 10 mg, at least 15 mg, at least 25 mg, at least 35 mg, at least 45 mg, at least 50 mg, at least 75 mg, or at least 100 mg. The lyophilized prophylactic or therapeutic agents or pharmaceutical compositions of the invention should be stored at between 2° C. and 8° C. in its original container and the prophylactic or therapeutic agents, or pharmaceutical compositions of the invention should be administered within 1 week, e.g., within 5 days, within 72 hours, within 48 hours, within 24 hours, within 12 hours, within 6 hours, within 5 hours, within 3 hours, or within 1 hour after being reconstituted. In an alternative embodiment, one or more of the prophylactic or therapeutic agents or pharmaceutical compositions of the invention is supplied in liquid form in a hermetically sealed container indicating the quantity and concentration of the agent. In an embodiment, the liquid form of the administered composition is supplied in a hermetically sealed container at least 0.25 mg/ml, at least 0.5 mg/ml, at least 1 mg/ml, at least 2.5 mg/ml, at least 5 mg/ml, at least 8 mg/ml, at least 10 mg/ml, at least 15 mg/kg, at least 25 mg/ml, at least 50 mg/ml, at least 75 mg/ml or at least 100 mg/ml. The liquid form should be stored at between 2° C. and 8° C. in its original container.

The binding proteins of the invention can be incorporated into a pharmaceutical composition suitable for parenteral administration. In an embodiment, the antibody or antibody-portions will be prepared as an injectable solution containing 0.1-250 mg/ml binding protein. The injectable solution can be composed of either a liquid or lyophilized dosage form in a flint or amber vial, ampule or pre-filled syringe. The buffer can be L-histidine (1-50 mM), optimally 5-10 mM, at pH 5.0 to 7.0 (optimally pH 6.0). Other suitable buffers include but are not limited to, sodium succinate, sodium citrate, sodium phosphate or potassium phosphate. Sodium chloride can be used to modify the toxicity of the solution at a concentration of 0-300 mM (optimally 150 mM for a liquid dosage form). Cryoprotectants can be included for a lyophilized dosage form, principally 0-10% sucrose (optimally 0.5-1.0%). Other suitable cryoprotectants include trehalose and lactose. Bulking agents can be included for a lyophilized dosage form, principally 1-10% mannitol (optimally 2-4%). Stabilizers can be used in both liquid and lyophilized dosage forms, principally 1-50 mM L-Methionine (optimally 5-10 mM). Other suitable bulking agents include glycine, arginine, can be included as 0-0.05% polysorbate-80 (optimally 0.005-0.01%). Additional surfactants include but are not limited to polysorbate 20 and BRIJ surfactants. The pharmaceutical composition comprising the binding proteins of the invention prepared as an injectable solution for parenteral administration, can further comprise an agent useful as an adjuvant, such as those used to increase the absorption, or dispersion of a therapeutic protein (e.g., antibody). A particularly useful adjuvant is hyaluronidase, such as Hylenex® (recombinant human hyaluronidase). Addition of hyaluronidase in the injectable solution improves human bioavailability following parenteral administration, particularly subcutaneous administration. It also allows for greater injection site volumes (i.e. greater than 1 ml) with less pain and discomfort, and minimum incidence of injection site reactions. (see WO2004078140, and US2006104968 incorporated herein by reference).

The compositions of this invention may be in a variety of forms. These include, for example, liquid, semi-solid and solid dosage forms, such as liquid solutions (e.g., injectable and infusible solutions), dispersions or suspensions, tablets, pills, powders, liposomes and suppositories. The form chosen depends on the intended mode of administration and therapeutic application. Typical compositions are in the form of injectable or infusible solutions, such as compositions similar to those used for passive immunization of humans with other antibodies. The chosen mode of administration is parenteral (e.g., intravenous, subcutaneous, intraperitoneal, intramuscular). In an embodiment, the antibody is administered by intravenous infusion or injection. In another embodiment, the antibody is administered by intramuscular or subcutaneous injection.

Therapeutic compositions typically must be sterile and stable under the conditions of manufacture and storage. The composition can be formulated as a solution, microemulsion, dispersion, liposome, or other ordered structure suitable to high drug concentration. Sterile injectable solutions can be prepared by incorporating the active compound (i.e., antibody or antibody portion) in the required amount in an appropriate solvent with one or a combination of ingredients enumerated herein, as required, followed by filtered sterilization. Generally, dispersions are prepared by incorporating the active compound into a sterile vehicle that contains a basic dispersion medium and the required other ingredients from those enumerated herein. In the case of sterile, lyophilized powders for the preparation of sterile injectable solutions, the methods of preparation are vacuum drying and spray-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including, in the composition, an agent that delays absorption, for example, monostearate salts and gelatin.

The binding proteins of the present invention can be administered by a variety of methods known in the art, although for many therapeutic applications, in an embodiment, the route/mode of administration is subcutaneous injection, intravenous injection or infusion. As will be appreciated by the skilled artisan, the route and/or mode of administration will vary depending upon the desired results. In certain embodiments, the active compound may be prepared with a carrier that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., *Sustained and Controlled Release Drug Delivery Systems,* J. R. Robinson, ed., Marcel Dekker, Inc., New York, 1978.

In certain embodiments, a binding protein of the invention may be orally administered, for example, with an inert diluent or an assimilable edible carrier. The compound (and other ingredients, if desired) may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound of the invention by other than parenteral administration, it may be necessary to coat the compound with, or co-administer the compound with, a material to prevent its inactivation.

Supplementary active compounds can also be incorporated into the compositions. In certain embodiments, a binding protein of the invention is coformulated with and/or coadministered with one or more additional therapeutic agents that are useful for treating disorders with binding protein of the invention. For example, a binding protein of the invention may be coformulated and/or coadministered with one or more additional antibodies that bind other targets (e.g., antibodies that bind other cytokines or that bind cell surface molecules). Furthermore, one or more antibodies of the invention may be used in combination with two or more of the foregoing therapeutic agents. Such combination therapies may advantageously utilize lower dosages of the administered therapeutic agents, thus avoiding possible toxicities or complications associated with the various monotherapies.

In certain embodiments, a binding protein is linked to a half-life extending vehicle known in the art. Such vehicles include, but are not limited to, the Fc domain, polyethylene glycol, and dextran. Such vehicles are described, e.g., in U.S. application Ser. No. 09/428,082 and published PCT Application No. WO 99/25044, which are hereby incorporated by reference for any purpose.

In a specific embodiment, nucleic acid sequences encoding a binding protein of the invention or another prophylactic or therapeutic agent of the invention are administered to treat, prevent, manage, or ameliorate a disorder or one or more symptoms thereof by way of gene therapy. Gene therapy refers to therapy performed by the administration to a subject of an expressed or expressible nucleic acid. In this embodiment of the invention, the nucleic acids produce their encoded antibody or prophylactic or therapeutic agent of the invention that mediates a prophylactic or therapeutic effect.

Any of the methods for gene therapy available in the art can be used according to the present invention. For general reviews of the methods of gene therapy, see Goldspiel et al., 1993, Clinical Pharmacy 12:488-505; Wu and Wu, 1991, Biotherapy 3:87-95; Tolstoshev, 1993, Ann. Rev. Pharmacol. Toxicol. 32:573-596; Mulligan, Science 260:926-932 (1993); and Morgan and Anderson, 1993, Ann. Rev. Biochem. 62:191-217; May, 1993, TIBTECH 11(5):155-215. Methods commonly known in the art of recombinant DNA technology which can be used are described in Ausubel et al. (eds.), Current Protocols in Molecular Biology, John Wiley &Sons, NY (1993); and Kriegler, Gene Transfer and Expression, A Laboratory Manual, Stockton Press, NY (1990). Detailed description of various methods of gene therapy are disclosed in US20050042664 A1 which is incorporated herein by reference.

The binding proteins of the invention are useful in treating various diseases wherein the targets that are recognized by the binding proteins are detrimental. Such diseases include, but are not limited to, rheumatoid arthritis, osteoarthritis, juvenile chronic arthritis, septic arthritis, Lyme arthritis, psoriatic arthritis, reactive arthritis, spondyloarthropathy, systemic lupus erythematosus, Crohn's disease, ulcerative colitis, inflammatory bowel disease, insulin dependent diabetes mellitus, thyroiditis, asthma, allergic diseases, psoriasis, dermatitis scleroderma, graft versus host disease, organ transplant rejection, acute or chronic immune disease associated with organ transplantation, sarcoidosis, atherosclerosis, disseminated intravascular coagulation, Kawasaki's disease, Grave's disease, nephrotic syndrome, chronic fatigue syndrome, Wegener's granulomatosis, Henoch-Schoenlein purpurea, microscopic vasculitis of the kidneys, chronic active hepatitis, uveitis, septic shock, toxic shock syndrome, sepsis syndrome, cachexia, infectious diseases, parasitic diseases, acquired immunodeficiency syndrome, acute transverse myelitis, Huntington's chorea, Parkinson's disease, Alzheimer's disease, stroke, primary biliary cirrhosis, hemolytic anemia, malignancies, heart failure, myocardial infarction, Addison's disease, sporadic, polyglandular deficiency type I and polyglandular deficiency type II, Schmidt's syndrome, adult (acute) respiratory distress syndrome, alopecia, alopecia greata, seronegative arthopathy, arthropathy, Reiter's disease, psoriatic arthropathy, ulcerative colitic arthropathy, enteropathic synovitis, *chlamydia, yersinia* and *salmonella* associated arthropathy, spondyloarthopathy, atheromatous disease/arteriosclerosis, atopic allergy, autoimmune bullous disease, pemphigus vulgaris, pemphigus foliaceus, pemphigoid, linear IgA disease, autoimmune haemolytic anaemia, Coombs positive haemolytic anaemia, acquired pernicious anaemia, juvenile pernicious anaemia, myalgic encephalitis/Royal Free Disease, chronic mucocutaneous candidiasis, giant cell arteritis, primary sclerosing hepatitis, cryptogenic autoimmune hepatitis, Acquired Immunodeficiency Disease Syndrome, Acquired Immunodeficiency Related Diseases, Hepatitis B, Hepatitis C, common varied immunodeficiency (common variable hypogammaglobulinaemia), dilated cardiomyopathy, female infertility, ovarian failure, premature ovarian failure, fibrotic lung disease, cryptogenic fibrosing alveolitis, post-inflammatory interstitial lung disease, interstitial pneumonitis, connective tissue disease associated interstitial lung disease, mixed connective tissue disease associated lung disease, systemic sclerosis associated interstitial lung disease, rheumatoid arthritis associated interstitial lung disease, systemic lupus erythematosus associated lung disease, dermatomyositis/polymyositis associated lung disease, Sjögren's disease associated lung disease, ankylosing spondylitis associated lung disease, vasculitic diffuse lung disease, haemosiderosis associated lung disease, drug-induced interstitial lung disease, fibrosis, radiation fibrosis, bronchiolitis obliterans, chronic eosinophilic pneumonia, lymphocytic infiltrative lung disease, postinfectious interstitial lung disease, gouty arthritis, autoimmune hepatitis, type-1 autoimmune hepatitis (classical autoimmune or lupoid hepatitis), type-2 autoimmune hepatitis (anti-LKM antibody hepatitis), autoimmune mediated hypoglycaemia, type B insulin resistance with acanthosis nigricans, hypoparathyroidism, acute immune disease associated with organ transplantation, chronic immune disease associated with organ transplantation, osteoarthrosis, primary sclerosing cholangitis, psoriasis type 1, psoriasis type 2, idiopathic leucopaenia, autoimmune neutropaenia, renal disease NOS, glomerulonephritides, microscopic vasculitis of the kidneys, lyme disease, discoid lupus erythematosus, male infertility idiopathic or NOS, sperm autoimmunity, multiple sclerosis (all subtypes), sympathetic ophthalmia, pulmonary hypertension secondary to connective tissue disease, Goodpasture's syndrome, pulmonary manifestation of polyarteritis nodosa, acute rheumatic fever, rheumatoid spondylitis, Still's disease, systemic sclerosis, Sjögren's syndrome, Takayasu's disease/arteritis, autoimmune thrombocytopaenia, idiopathic thrombocytopaenia, autoimmune thyroid disease, hyperthyroidism, goitrous autoimmune hypothyroidism (Hashimoto's disease), atrophic autoimmune hypothyroidism, primary myxoedema, phacogenic uveitis, primary vasculitis, vitiligo acute liver disease, chronic liver diseases, alcoholic cirrhosis, alcohol-induced liver injury, choleosatatis, idiosyncratic liver disease, Drug-Induced hepatitis, Non-alcoholic Steatohepatitis, allergy and asthma, group B streptococci (GBS) infection, mental disorders (e.g., depression and schizophrenia), Th2 Type and Th1 Type mediated diseases, acute and chronic pain (different forms of pain), and cancers such as lung, breast, stomach, bladder, colon, pancreas, ovarian, prostate and rectal cancer and hematopoietic malignancies (leukemia and lymphoma), Abetalipoprotemia, Acrocyanosis, acute and chronic parasitic or infectious processes, acute leukemia, acute lymphoblastic leukemia (ALL), acute myeloid leukemia (AML), acute or chronic bacterial infection, acute pancreatitis, acute renal failure, adenocarcinomas, aerial ectopic beats, AIDS dementia complex, alcohol-induced hepatitis, allergic conjunctivitis, allergic contact dermatitis, allergic rhinitis, allograft rejection, alpha-1-antitrypsin deficiency, amyotrophic lateral sclerosis, anemia, angina pectoris, anterior horn cell degeneration, anti cd3 therapy, antiphospholipid syndrome, anti-receptor hypersensitivity reactions, aordic and peripheral aneuryisms, aortic dissection, arterial hypertension, arteriosclerosis, arteriovenous fistula, ataxia, atrial fibrillation (sustained or paroxysmal), atrial flutter, atrioventricular block, B cell lymphoma, bone graft rejection, bone marrow transplant (BMT) rejection, bundle branch block, Burkitt's lymphoma, Burns, cardiac arrhythmias, cardiac stun syndrome, cardiac tumors, cardiomyopathy, cardiopulmonary bypass inflammation response, cartilage transplant rejection, cerebellar cortical degenerations, cerebellar disorders, chaotic or multifocal atrial tachycardia, chemotherapy associated disorders, chromic myelocytic leukemia (CML), chronic alcoholism, chronic inflammatory pathologies, chronic lymphocytic leukemia (CLL), chronic obstructive pulmonary disease (COPD), chronic salicylate intoxication, colorectal carcinoma, congestive heart failure, conjunctivitis, contact dermatitis, cor pulmonale, coronary artery disease, Creutzfeldt-Jakob disease, culture negative sepsis, cystic fibrosis, cytokine therapy associated disorders, Dementia pugilistica, demyelinating diseases, dengue hemorrhagic fever, dermatitis, dermatologic conditions, diabetes, diabetes mellitus, diabetic ateriosclerotic disease, Diffuse Lewy body disease, dilated congestive cardiomyopathy, disorders of the basal ganglia, Down's Syndrome in middle age, drug-induced movement disorders induced by drugs which block CNS dopamine receptors, drug sensitivity, eczema, encephalomyelitis, endocarditis, endocrinopathy, epiglottitis, epstein-barr virus infection, erythromelalgia, extrapyramidal and cerebellar disorders, familial hematophagocytic lymphohistiocytosis, fetal thymus implant rejection, Friedreich's ataxia, functional peripheral arterial disorders, fungal sepsis, gas gangrene, gastric ulcer, glomerular nephritis, graft rejection of any organ or tissue, gram negative sepsis, gram positive sepsis, granulomas due to intracellular organisms, hairy cell leukemia, Hallervorden-Spatz disease, hashimoto's thyroiditis, hay fever, heart transplant rejection, hemachromatosis, hemodialysis, hemolytic uremic syndrome/thrombolytic thrombocytopenic purpura, hemorrhage, hepatitis (A), His bundle arrythmias, HIV infection/HIV neuropathy, Hodgkin's disease, hyperkinetic movement disorders, hypersensitity reactions, hypersensitivity pneumonitis, hypertension, hypokinetic movement disorders, hypothalamic-pituitary-adrenal axis evaluation, idiopathic Addison's disease, idiopathic pulmonary fibrosis, antibody mediated cytotoxicity, Asthenia, infantile spinal muscular atrophy, inflammation of the aorta, influenza a, ionizing radiation exposure, iridocyclitis/uveitis/optic neuritis, ischemia-reperfusion injury, ischemic stroke, juvenile rheumatoid arthritis, juvenile spinal muscular atrophy, Kaposi's sarcoma, kidney transplant rejection, legionella, leishmaniasis, leprosy, lesions of the corticospinal system, lipedema, liver transplant rejection, lymphederma, malaria, malignant Lymphoma, malignant histiocytosis, malignant melanoma, meningitis, meningococcemia, metabolic/idiopathic, migraine headache, mitochondrial multi.system disorder, mixed connective tissue disease, monoclonal gammopathy, multiple myeloma, multiple systems degenerations (Mencel Dejerine-Thomas Shi-Drager and Machado-Joseph), myasthenia gravis, *mycobacterium avium* intracellulare, *mycobacterium tuberculosis*, myelodyplastic syndrome, myocardial infarction, myocardial ischemic disorders, nasopharyngeal carcinoma, neonatal chronic lung disease, nephritis, nephrosis, neurodegenerative diseases, neurogenic I muscular atrophies, neutropenic fever, non-hodgkins lymphoma, occlusion of the abdominal aorta and its branches, occlusive arterial disorders, okt3 therapy, orchitis/epididimitis, orchitis/vasectomy reversal procedures, organomegaly, osteoporosis, pancreas transplant rejection, pancreatic carcinoma, paraneoplastic syndrome/hypercalcemia of malignancy, parathyroid transplant rejection, pelvic inflammatory disease, perennial rhinitis, pericardial disease, peripheral atherlosclerotic disease, peripheral vascular disorders, peritonitis, pernicious anemia, *pneumocystis carinii* pneumonia, pneumonia, POEMS syndrome (polyneuropathy, organomegaly, endocrinopathy, monoclonal gammopathy, and skin changes syndrome), post perfusion syndrome, post pump syndrome, post-MI cardiotomy syndrome, preeclampsia, Progressive supranucleo Palsy, primary pulmonary hypertension, radiation therapy, Raynaud's phenomenon and disease, Raynoud's disease, Refsum's disease, regular narrow QRS tachycardia, renovascular hypertension, reperfusion injury, restrictive cardiomyopathy, sarcomas, scleroderma, senile chorea, Senile Dementia of Lewy body type, seronegative arthropathies, shock, sickle cell anemia, skin allograft rejection, skin changes syndrome, small bowel transplant rejection, solid tumors, specific arrythmias, spinal ataxia, spinocerebellar degenerations, streptococcal myositis, structural lesions of the cerebellum, Subacute sclerosing panencephalitis, Syncope, syphilis of the cardiovascular system, systemic anaphalaxis, systemic inflammatory response syndrome, systemic onset juvenile rheumatoid arthritis, T-cell or FAB ALL, Telangiectasia, thromboangitis obliterans, thrombocytopenia, toxicity, transplants, trauma/hemorrhage, type III hypersensitivity reactions, type IV hypersensitivity, unstable angina, uremia, urosepsis, urticaria, valvular heart diseases, varicose veins, vasculitis, venous diseases, venous thrombosis, ventricular fibrillation, viral and fungal infections, vital encephalitis/aseptic meningitis, vital-associated hemaphagocytic syndrome, Wernicke-Korsakoff syndrome, Wilson's disease, xenograft rejection of any organ or tissue. (see Peritt et al. PCT publication No. WO2002097048A2, Leonard et al., PCT publication No. WO9524918 A1, and Salfeld et al., PCT publication No. WO00/56772A1).

The binding proteins of the invention can be used to treat humans suffering from autoimmune diseases, in particular those associated with inflammation, including, rheumatoid arthritis, spondylitis, allergy, autoimmune diabetes, autoimmune uveitis. In an embodiment, the binding proteins of the invention or antigen-binding portions thereof, are used to treat rheumatoid arthritis, Crohn's disease, multiple sclerosis, insulin dependent diabetes mellitus and psoriasis.

In an embodiment, diseases that can be treated or diagnosed with the compositions and methods of the invention include, but are not limited to, primary and metastatic cancers, including carcinomas of breast, colon, rectum, lung, oropharynx, hypopharynx, esophagus, stomach, pancreas, liver, gallbladder and bile ducts, small intestine, urinary tract (including kidney, bladder and urothelium), female genital tract (including cervix, uterus, and ovaries as well as choriocarcinoma and gestational trophoblastic disease), male genital tract (including prostate, seminal vesicles, testes and germ cell tumors), endocrine glands (including the thyroid, adrenal, and pituitary glands), and skin, as well as hemangiomas, melanomas, sarcomas (including those arising from bone and soft tissues as well as Kaposi's sarcoma), tumors of the brain, nerves, eyes, and meninges (including astrocytomas, gliomas, glioblastomas, retinoblastomas, neuromas, neuroblastomas, Schwannomas, and meningiomas), solid tumors arising from hematopoietic malignancies such as leukemias, and lymphomas (both Hodgkin's and non-Hodgkin's lymphomas).

In an embodiment, the antibodies of the invention or antigen-binding portions thereof, are used to treat cancer or in the prevention of metastases from the tumors described herein either when used alone or in combination with radiotherapy and/or other chemotherapeutic agents.

The antibodies of the invention, or antigen binding portions thereof, may be combined with agents that include but are not limited to, antineoplastic agents, radiotherapy, chemotherapy such as DNA alkylating agents, cisplatin, carboplatin, antitubulin agents, paclitaxel, docetaxel, taxol, doxorubicin, gemcitabine, gemzar, anthracyclines, adriamycin, topoisomerase I inhibitors, topoisomerase II inhibitors, 5-fluorouracil (5-FU), leucovorin, irinotecan, receptor tyrosine kinase inhibitors (e.g., erlotinib, gefitinib), COX-2 inhibitors (e.g., celecoxib), kinase inhibitors, and siRNAs.

A binding protein of the invention also can be administered with one or more additional therapeutic agents useful in the treatment of various diseases.

A binding protein of the invention can be used alone or in combination to treat such diseases. It should be understood that the binding proteins can be used alone or in combination with an additional agent, e.g., a therapeutic agent, said additional agent being selected by the skilled artisan for its intended purpose. For example, the additional agent can be a therapeutic agent art-recognized as being useful to treat the disease or condition being treated by the antibody of the present invention. The additional agent also can be an agent that imparts a beneficial attribute to the therapeutic composition e.g., an agent which effects the viscosity of the composition.

It should further be understood that the combinations which are to be included within this invention are those combinations useful for their intended purpose. The agents set forth below are illustrative for purposes and not intended to be limited. The combinations, which are part of this invention, can be the antibodies of the present invention and at least one additional agent selected from the lists below. The combination can also include more than one additional agent, e.g., two or three additional agents if the combination is such that the formed composition can perform its intended function.

Combinations to treat autoimmune and inflammatory diseases are non-steroidal anti-inflammatory drug(s) also referred to as NSAIDS which include drugs like ibuprofen. Other combinations are corticosteroids including prednisolone; the well known side-effects of steroid use can be reduced or even eliminated by tapering the steroid dose required when treating patients in combination with the DVD Igs of this invention. Non-limiting examples of therapeutic agents for rheumatoid arthritis with which an antibody, or antibody portion, of the invention can be combined include the following: cytokine suppressive anti-inflammatory drug(s) (CSAIDs); antibodies to or antagonists of other human cytokines or growth factors, for example, TNF, LT, IL-1, IL-2, IL-3, IL-4, IL-5, IL-6, IL-7, IL-8, IL-15, IL-16, IL-18, IL-21, IL-23, interferons, EMAP-II, GM-CSF, FGF, and PDGF. Binding proteins of the invention, or antigen binding portions thereof, can be combined with antibodies to cell surface molecules such as CD2, CD3, CD4, CD8, CD25, CD28, CD30, CD40, CD45, CD69, CD80 (B7.1), CD86 (B7.2), CD90, CTLA or their ligands including CD154 (gp39 or CD40L).

Combinations of therapeutic agents may interfere at different points in the autoimmune and subsequent inflammatory cascade; examples include TNF antagonists like chimeric, humanized or human TNF antibodies, ADALIMUMAB, (PCT Publication No. WO 97/29131), CA2 (Remicade™), CDP 571, and soluble p55 or p75 TNF receptors, derivatives, thereof, (p75TNFR1gG (Enbrel™) or p55TNFR1gG (Lenercept), and also TNF ix converting enzyme (TACE) inhibitors; similarly IL-1 inhibitors (Interleukin-1-converting enzyme inhibitors, IL-1RA etc.) may be effective for the same reason. Other combinations include Interleukin 11. Yet another combination include key players of the autoimmune response which may act parallel to, dependent on or in concert with IL-12 function; especially are IL-18 antagonists including IL-18 antibodies or soluble IL-18 receptors, or IL-18 binding proteins. It has been shown that IL-12 and IL-18 have overlapping but distinct functions and a combination of antagonists to both may be most effective. Yet another combination are non-depleting anti-CD4 inhibitors. Yet other combinations include antagonists of the co-stimulatory pathway CD80 (B7.1) or CD86 (B7.2) including antibodies, soluble receptors or antagonistic ligands.

The binding proteins of the invention may also be combined with agents, such as methotrexate, 6-MP, azathioprine sulphasalazine, mesalazine, olsalazine chloroquinine/hydroxychloroquine, pencillamine, aurothiomalate (intramuscular and oral), azathioprine, cochicine, corticosteroids (oral, inhaled and local injection), beta-2 adrenoreceptor agonists (salbutamol, terbutaline, salmeteral), xanthines (theophylline, aminophylline), cromoglycate, nedocromil, ketotifen, ipratropium and oxitropium, cyclosporin, FK506, rapamycin, mycophenolate mofetil, leflunomide, NSAIDs, for example, ibuprofen, corticosteroids such as prednisolone, phosphodiesterase inhibitors, adensosine agonists, antithrombotic agents, complement inhibitors, adrenergic agents, agents which interfere with signalling by proinflammatory cytokines such as TNF-α or IL-1 (e.g., IRAK, NIK, IKK, p38 or MAP kinase inhibitors), IL-1β converting enzyme inhibitors, TNFα converting enzyme (TACE) inhibitors, T-cell signalling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors and the derivatives p75TNFRIgG (Enbrel™ and p55TNFRIgG (Lenercept)), sIL-1RI, sIL-1RII, sIL-6R), antiinflammatory cytokines (e.g., IL-4, IL-10, IL-11, IL-13 and TGFβ), celecoxib, folic acid, hydroxychloroquine sulfate, rofecoxib, etanercept, infliximab, naproxen, valdecoxib, sulfasalazine, methylprednisolone, meloxicam, methylprednisolone acetate, gold sodium thiomalate, aspirin, triamcinolone acetonide, propoxyphene napsylate/apap, folate, nabumetone, diclofenac, piroxicam, etodolac, diclofenac sodium, oxaprozin, oxycodone hcl, hydrocodone bitartrate/apap, diclofenac sodium/misoprostol, fentanyl, anakinra, human recombinant, tramadol hcl, salsalate, sulindac, cyanocobalamin/fa/pyridoxine, acetaminophen, alendronate sodium, prednisolone, morphine sulfate, lidocaine hydrochloride, indomethacin, glucosamine sulf/chondroitin, amitriptyline hcl, sulfadiazine, oxycodone hcl/acetaminophen, olopatadine hcl, misoprostol, naproxen sodium, omeprazole, cyclophosphamide, rituximab, IL-1 TRAP, MRA, CTLA4-IG, IL-18 BP, anti-IL-18, Anti-IL15, BIRB-796, SCIO-469, VX-702, AMG-548, VX-740, Roflumilast, IC-485, CDC-801, and Mesopram. Combinations include methotrexate or leflunomide and in moderate or severe rheumatoid arthritis cases, cyclosporine.

Nonlimiting additional agents which can also be used in combination with a binding protein to treat rheumatoid arthritis include, but are not limited to, the following: non-steroidal anti-inflammatory drug(s) (NSAIDs); cytokine suppressive anti-inflammatory drug(s) (CSAIDs); CDP-571/BAY-10-3356 (humanized anti-TNFα antibody; Celltech/Bayer); cA2/infliximab (chimeric anti-TNFα antibody; Centocor); 75 kdTNFR-IgG/etanercept (75 kD TNF receptor-IgG fusion protein; Immunex; see e.g., *Arthritis & Rheumatism* (1994) Vol. 37, S295; *J. Invest. Med.* (1996) Vol. 44, 235A); 55 kdTNF-IgG (55 kD TNF receptor-IgG fusion protein; Hoffmann-LaRoche); IDEC-CE9.1/SB 210396 (non-depleting primatized anti-CD4 antibody; IDEC/SmithKline; see e.g., *Arthritis & Rheumatism* (1995) Vol. 38, S185); DAB 486-IL-2 and/or DAB 389-IL-2 (IL-2 fusion proteins; Seragen; see e.g., *Arthritis & Rheumatism* (1993) Vol. 36, 1223); Anti-Tac (humanized anti-IL-2Ra; Protein Design Labs/Roche); IL-4 (anti-inflammatory cytokine; DNAX/Schering); IL-10 (SCH 52000; recombinant IL-10, anti-inflammatory cytokine; DNAX/Schering); IL-4; IL-10 and/or IL-4 agonists (e.g., agonist antibodies); IL-1RA (IL-1 receptor antagonist; Synergen/Amgen); anakinra (Kineret®/Amgen); TNF-bp/s-TNF (soluble TNF binding protein; see e.g., *Arthritis & Rheumatism* (1996) Vol. 39, No. 9 (supplement), 5284; *Amer. J. Physiol.—Heart and Circulatory Physiology* (1995) Vol. 268, pp. 37-42); R973401 (phosphodiesterase Type IV inhibitor; see e.g., *Arthritis & Rheumatism* (1996) Vol. 39, No. 9 (supplement), S282); MK-966 (COX-2 Inhibitor; see e.g., *Arthritis & Rheumatism* (1996) Vol. 39, No. 9 (supplement), S81); Iloprost (see e.g., *Arthritis & Rheumatism* (1996) Vol. 39, No. 9 (supplement), S82); methotrexate; thalidomide (see e.g., *Arthritis & Rheumatism* (1996) Vol. 39, No. 9 (supplement), 5282) and thalidomide-related drugs (e.g., Celgen); leflunomide (anti-inflammatory and cytokine inhibitor; see e.g., *Arthritis & Rheumatism* (1996) Vol. 39, No. 9 (supplement), 5131; *Inflammation Research* (1996) Vol. 45, pp. 103-107); tranexamic acid (inhibitor of plasminogen activation; see e.g., *Arthritis & Rheumatism* (1996) Vol. 39, No. 9 (supplement), S284); T-614 (cytokine inhibitor; see e.g., *Arthritis & Rheumatism* (1996) Vol. 39, No. 9 (supplement), S282); prostaglandin E1 (see e.g., *Arthritis & Rheumatism* (1996) Vol. 39, No. 9 (supplement), S282); Tenidap (non-steroidal anti-inflammatory drug; see e.g., *Arthritis & Rheumatism* (1996) Vol. 39, No. 9 (supplement), S280); Naproxen (non-steroidal anti-inflammatory drug; see e.g., *Neuro Report* (1996) Vol. 7, pp. 1209-1213); Meloxicam (non-steroidal anti-inflammatory drug); Ibuprofen (non-steroidal anti-inflammatory drug); Piroxicam (non-steroidal anti-inflammatory drug); Diclofenac (non-steroidal anti-inflammatory drug); Indomethacin (non-steroidal anti-inflammatory drug); Sulfasalazine (see e.g., *Arthritis & Rheumatism* (1996) Vol. 39, No. 9 (supplement), S281); Azathioprine (see e.g., *Arthritis & Rheumatism* (1996) Vol. 39, No. 9 (supplement), S281); ICE inhibitor (inhibitor of the enzyme interleukin-1β converting enzyme); zap-70 and/or lck inhibitor (inhibitor of the tyrosine kinase zap-70 or lck); VEGF inhibitor and/or VEGF-R inhibitor (inhibitors of vascular endothelial cell growth factor or vascular endothelial cell growth factor receptor; inhibitors of angiogenesis); corticosteroid anti-inflammatory drugs (e.g., SB203580); TNF-convertase inhibitors; anti-IL-12 antibodies; anti-IL-18 antibodies; interleukin-11 (see e.g., *Arthritis & Rheumatism* (1996) Vol. 39, No. 9 (supplement), S296); interleukin-13 (see e.g., *Arthritis & Rheumatism* (1996) Vol. 39, No. 9 (supplement), S308); interleukin-17 inhibitors (see e.g., *Arthritis & Rheumatism* (1996) Vol. 39, No. 9 (supplement), S120); gold; penicillamine; chloroquine; chlorambucil; hydroxychloroquine; cyclosporine; cyclophosphamide; total lymphoid irradiation; anti-thymocyte globulin; anti-CD4 antibodies; CD5-toxins; orally-administered peptides and collagen; lobenzarit disodium; Cytokine Regulating Agents (CRAs) HP228 and HP466 (Houghten Pharmaceuticals, Inc.); ICAM-1 antisense phosphorothioate oligo-deoxynucleotides (ISIS 2302; Isis Pharmaceuticals, Inc.); soluble complement receptor 1 (TP10; T Cell Sciences, Inc.); prednisone; orgotein; glycosaminoglycan polysulphate; minocycline; anti-IL2R antibodies; marine and botanical lipids (fish and plant seed fatty acids; see e.g., DeLuca et al. (1995) *Rheum. Dis. Clin. North Am.* 21:759-777); auranofin; phenylbutazone; meclofenamic acid; flufenamic acid; intravenous immune globulin; zileuton; azaribine; mycophenolic acid (RS-61443); tacrolimus (FK-506); sirolimus (rapamycin); amiprilose (therafectin); cladribine (2-chlorodeoxyadenosine); methotrexate; bcl-2 inhibitors (see Bruncko, Milan et al., Journal of Medicinal Chemistry (2007), 50(4), 641-662); antivirals and immune modulating agents.

In one embodiment, the binding protein or antigen-binding portion thereof, is administered in combination with one of the following agents for the treatment of rheumatoid arthritis: small molecule inhibitor of KDR, small molecule inhibitor of Tie-2; methotrexate; prednisone; celecoxib; folic acid; hydroxychloroquine sulfate; rofecoxib; etanercept; infliximab; leflunomide; naproxen; valdecoxib; sulfasalazine; methylprednisolone; ibuprofen; meloxicam; methylprednisolone acetate; gold sodium thiomalate; aspirin; azathioprine; triamcinolone acetonide; propoxyphene napsylate/apap; folate; nabumetone; diclofenac; piroxicam; etodolac; diclofenac sodium; oxaprozin; oxycodone hcl; hydrocodone bitartrate/apap; diclofenac sodium/misoprostol; fentanyl; anakinra, human recombinant; tramadol hcl; salsalate; sulindac; cyanocobalamin/fa/pyridoxine; acetaminophen; alendronate sodium; prednisolone; morphine sulfate; lidocaine hydrochloride; indomethacin; glucosamine sulfate/chondroitin; cyclosporine; amitriptyline hcl; sulfadiazine; oxycodone hcl/acetaminophen; olopatadine hcl; misoprostol; naproxen sodium; omeprazole; mycophenolate mofetil; cyclophosphamide; rituximab; IL-1 TRAP; MRA; CTLA4-IG; IL-18 BP; IL-12/23; anti-IL 18; anti-IL 15; BIRB-796; SCIO-469; VX-702; AMG-548; VX-740; Roflumilast; IC-485; CDC-801; and mesopram.

Non-limiting examples of therapeutic agents for inflammatory bowel disease with which a binding protein of the invention can be combined include the following: budenoside; epidermal growth factor; corticosteroids; cyclosporin, sulfasalazine; aminosalicylates; 6-mercaptopurine; azathioprine; metronidazole; lipoxygenase inhibitors; mesalamine; olsalazine; balsalazide; antioxidants; thromboxane inhibitors; IL-1 receptor antagonists; anti-IL-1β mAbs; anti-IL-6 mAbs; growth factors; elastase inhibitors; pyridinyl-imidazole compounds; antibodies to or antagonists of other human cytokines or growth factors, for example, TNF, LT, IL-1, IL-2, IL-6, IL-7, IL-8, IL-15, IL-16, IL-17, IL-18, EMAP-II, GM-CSF, FGF, and PDGF. Antibodies of the invention, or antigen binding portions thereof, can be combined with antibodies to cell surface molecules such as CD2, CD3, CD4, CD8, CD25, CD28, CD30, CD40, CD45, CD69, CD90 or their ligands. The antibodies of the invention, or antigen binding portions thereof, may also be combined with agents, such as methotrexate, cyclosporin, FK506, rapamycin, mycophenolate mofetil, leflunomide, NSAIDs, for example, ibuprofen, corticosteroids such as prednisolone, phosphodiesterase inhibitors, adenosine agonists, antithrombotic agents, complement inhibitors, adrenergic agents, agents which interfere with signalling by proinflammatory cytokines such as TNFα or IL-1 (e.g., IRAK, NIK, IKK, p38 or MAP kinase inhibitors), IL-1β converting enzyme inhibitors, TNFα converting enzyme inhibitors, T-cell signalling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors, sIL-1RI, sIL-1RII, sIL-6R) and antiinflammatory cytokines (e.g., IL-4, IL-10, IL-11, IL-13 and TGFβ) and bcl-2 inhibitors.

Examples of therapeutic agents for Crohn's disease in which a binding protein can be combined include the following: TNF antagonists, for example, anti-TNF antibodies, ADALIMUMAB (PCT Publication No. WO 97/29131; HUMIRA), CA2 (REMICADE), CDP 571, TNFR-Ig constructs, (p75TNFRIgG (ENBREL) and p55TNFRIgG (LENERCEPT)) inhibitors and PDE4 inhibitors. Antibodies of the invention, or antigen binding portions thereof, can be combined with corticosteroids, for example, budenoside and dexamethasone. Binding proteins of the invention or antigen binding portions thereof, may also be combined with agents such as sulfasalazine, 5-aminosalicylic acid and olsalazine, and agents which interfere with synthesis or action of proinflammatory cytokines such as IL-1, for example, IL-1β converting enzyme inhibitors and IL-1ra. Antibodies of the invention or antigen binding portion thereof may also be used with T cell signaling inhibitors, for example, tyrosine kinase inhibitors 6-mercaptopurines. Binding proteins of the invention, or antigen binding portions thereof, can be combined with IL-11. Binding proteins of the invention, or antigen binding portions thereof, can be combined with mesalamine, prednisone, azathioprine, mercaptopurine, infliximab, methylprednisolone sodium succinate, diphenoxylate/atrop sulfate, loperamide hydrochloride, methotrexate, omeprazole, folate, ciprofloxacin/dextrose-water, hydrocodone bitartrate/apap, tetracycline hydrochloride, fluocinonide, metronidazole, thimerosal/boric acid, cholestyramine/sucrose, ciprofloxacin hydrochloride, hyoscyamine sulfate, meperidine hydrochloride, midazolam hydrochloride, oxycodone hcl/acetaminophen, promethazine hydrochloride, sodium phosphate, sulfamethoxazole/trimethoprim, celecoxib, polycarbophil, propoxyphene napsylate, hydrocortisone, multivitamins, balsalazide disodium, codeine phosphate/apap, colesevelam hcl, cyanocobalamin, folic acid, levofloxacin, methylprednisolone, natalizumab and interferon-gamma Non-limiting examples of therapeutic agents for multiple sclerosis with which binding proteins of the invention can be combined include the following: corticosteroids; prednisolone; methylprednisolone; azathioprine; cyclophosphamide; cyclosporine; methotrexate; 4-aminopyridine; tizanidine; interferon-β1a (AVONEX; Biogen); interferon-β1b (BETASERON; Chiron/Berlex); interferon α-n3) (Interferon Sciences/Fujimoto), interferon-α (Alfa Wassermann/J&J), interferon β1A-IF (Serono/Inhale Therapeutics), Peginterferon α 2b (Enzon/Schering-Plough), Copolymer 1 (Cop-1; COPAXONE; Teva Pharmaceutical Industries, Inc.); hyperbaric oxygen; intravenous immunoglobulin; clabribine; antibodies to or antagonists of other human cytokines or growth factors and their receptors, for example, TNF, LT, IL-1, IL-2, IL-6, IL-7, IL-8, IL-23, IL-15, IL-16, IL-18, EMAP-II, GM-CSF, FGF, and PDGF. Binding proteins of the invention can be combined with antibodies to cell surface molecules such as CD2, CD3, CD4, CD8, CD19, CD20, CD25, CD28, CD30, CD40, CD45, CD69, CD80, CD86, CD90 or their ligands. Binding proteins of the invention, may also be combined with agents, such as methotrexate, cyclosporine, FK506, rapamycin, mycophenolate mofetil, leflunomide, NSAIDs, for example, ibuprofen, corticosteroids such as prednisolone, phosphodiesterase inhibitors, adensosine agonists, antithrombotic agents, complement inhibitors, adrenergic agents, agents which interfere with signalling by proinflammatory cytokines such as TNFα or IL-1 (e.g., IRAK, NIK, IKK, p38 or MAP kinase inhibitors), IL-1β converting enzyme inhibitors, TACE inhibitors, T-cell signaling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors, sIL-1RI, sIL-1RII, sIL-6R), antiinflammatory cytokines (e.g., IL-4, IL-10, IL-13 and TGFβ) and bcl-2 inhibitors.

Examples of therapeutic agents for multiple sclerosis in which binding proteins of the invention can be combined to include interferon-β, for example, IFNβ1a and IFNβ1b; copaxone, corticosteroids, caspase inhibitors, for example inhibitors of caspase-1, IL-1 inhibitors, TNF inhibitors, and antibodies to CD40 ligand and CD80.

The binding proteins of the invention, may also be combined with agents, such as alemtuzumab, dronabinol, Unimed, daclizumab, mitoxantrone, xaliproden hydrochloride, fampridine, glatiramer acetate, natalizumab, sinnabidol, a-immunokine NNSO3, ABR-215062, AnergiX.MS, chemokine receptor antagonists, BBR-2778, calagualine, CPI-1189, LEM (liposome encapsulated mitoxantrone), THC.CBD (cannabinoid agonist) MBP-8298, mesopram (PDE4 inhibitor), MNA-715, anti-IL-6 receptor antibody, neurovax, pirfenidone allotrap 1258 (RDP-1258), sTNF-R1, talampanel, teriflunomide, TGF-beta2, tiplimotide, VLA-4 antagonists (for example, TR-14035, VLA4 Ultrahaler, Antegran-ELAN/Biogen), interferon gamma antagonists, IL-4 agonists.

Non-limiting examples of therapeutic agents for Angina with which binding proteins of the invention can be combined include the following: aspirin, nitroglycerin, isosorbide mononitrate, metoprolol succinate, atenolol, metoprolol tartrate, amlodipine besylate, diltiazem hydrochloride, isosorbide dinitrate, clopidogrel bisulfate, nifedipine, atorvastatin calcium, potassium chloride, furosemide, simvastatin, verapamil hcl, digoxin, propranolol hydrochloride, carvedilol, lisinopril, spironolactone, hydrochlorothiazide, enalapril maleate, nadolol, ramipril, enoxaparin sodium, heparin sodium, valsartan, sotalol hydrochloride, fenofibrate, ezetimibe, bumetanide, losartan potassium, lisinopril/hydrochlorothiazide, felodipine, captopril, bisoprolol fumarate.

Non-limiting examples of therapeutic agents for Ankylosing Spondylitis with which binding proteins of the invention can be combined include the following: ibuprofen, diclofenac and misoprostol, naproxen, meloxicam, indomethacin, diclofenac, celecoxib, rofecoxib, Sulfasalazine, Methotrexate, azathioprine, minocyclin, prednisone, etanercept, infliximab.

Non-limiting examples of therapeutic agents for Asthma with which binding proteins of the invention can be combined include the following: albuterol, salmeterol/fluticasone, montelukast sodium, fluticasone propionate, budesonide, prednisone, salmeterol xinafoate, levalbuterol hcl, albuterol sulfate/ipratropium, prednisolone sodium phosphate, triamcinolone acetonide, beclomethasone dipropionate, ipratropium bromide, azithromycin, pirbuterol acetate, prednisolone, theophylline anhydrous, methylprednisolone sodium succinate, clarithromycin, zafirlukast, formoterol fumarate, influenza virus vaccine, methylprednisolone, amoxicillin trihydrate, flunisolide, allergy injection, cromolyn sodium, fexofenadine hydrochloride, flunisolide/menthol, amoxicillin/clavulanate, levofloxacin, inhaler assist device, guaifenesin, dexamethasone sodium phosphate, moxifloxacin hcl, doxycycline hyclate, guaifenesin/d-methorphan, p-ephedrine/cod/chlorphenir, gatifloxacin, cetirizine hydrochloride, mometasone furoate, salmeterol xinafoate, benzonatate, cephalexin, pe/hydrocodone/chlorphenir, cetirizine hcl/pseudoephed, phenylephrine/cod/promethazine, codeine/promethazine, cefprozil, dexamethasone, guaifenesin/pseudoephedrine, chlorpheniramine/hydrocodon, nedocromil sodium, terbutaline sulfate, epinephrine, methylprednisolone, metaproterenol sulfate.

Non-limiting examples of therapeutic agents for COPD with which binding proteins of the invention can be combined include the following: albuterol sulfate/ipratropium, ipratropium bromide, salmeterol/fluticasone, albuterol, salmeterol xinafoate, fluticasone propionate, prednisone, theophylline anhydrous, methylprednisolone sodium succinate, montelukast sodium, budesonide, formoterol fumarate, triamcinolone acetonide, levofloxacin, guaifenesin, azithromycin, beclomethasone dipropionate, levalbuterol hcl, flunisolide, ceftriaxone sodium, amoxicillin trihydrate, gatifloxacin, zafirlukast, amoxicillin/clavulanate, flunisolide/menthol, chlorpheniramine/hydrocodone, metaproterenol sulfate, methylprednisolone, mometasone furoate, p-ephedrine/cod/chlorphenir, pirbuterol acetate, p-ephedrine/loratadine, terbutaline sulfate, tiotropium bromide, (R,R)-formoterol, TgAAT, Cilomilast, Roflumilast.

Non-limiting examples of therapeutic agents for HCV with which binding proteins of the invention can be combined include the following: Interferon-alpha-2a, Interferon-alpha-2b, Interferon-alpha con1, Interferon-alpha-n1, Pegylated interferon-alpha-2a, Pegylated interferon-alpha-2b, ribavirin, Peginterferon alfa-2b+ribavirin, Ursodeoxycholic Acid, Glycyrrhizic Acid, Thymalfasin, Maxamine, VX-497 and any compounds that are used to treat HCV through intervention with the following targets: HCV polymerase, HCV protease, HCV helicase, HCV IRES (internal ribosome entry site).

Non-limiting examples of therapeutic agents for Idiopathic Pulmonary Fibrosis with which binding proteins of the invention can be combined include the following: prednisone, azathioprine, albuterol, colchicine, albuterol sulfate, digoxin, gamma interferon, methylprednisolone sod succ, lorazepam, furosemide, lisinopril, nitroglycerin, spironolactone, cyclophosphamide, ipratropium bromide, actinomycin d, alteplase, fluticasone propionate, levofloxacin, metaproterenol sulfate, morphine sulfate, oxycodone hcl, potassium chloride, triamcinolone acetonide, tacrolimus anhydrous, calcium, interferon-alpha, methotrexate, mycophenolate mofetil, Interferon-gamma-1β.

Non-limiting examples of therapeutic agents for Myocardial Infarction with which binding proteins of the invention can be combined include the following: aspirin, nitroglycerin, metoprolol tartrate, enoxaparin sodium, heparin sodium, clopidogrel bisulfate, carvedilol, atenolol, morphine sulfate, metoprolol succinate, warfarin sodium, lisinopril, isosorbide mononitrate, digoxin, furosemide, simvastatin, ramipril, tenecteplase, enalapril maleate, torsemide, retavase, losartan potassium, quinapril hcl/mag carb, bumetanide, alteplase, enalaprilat, amiodarone hydrochloride, tirofiban hcl m-hydrate, diltiazem hydrochloride, captopril, irbesartan, valsartan, propranolol hydrochloride, fosinopril sodium, lidocaine hydrochloride, eptifibatide, cefazolin sodium, atropine sulfate, aminocaproic acid, spironolactone, interferon, sotalol hydrochloride, potassium chloride, docusate sodium, dobutamine hcl, alprazolam, pravastatin sodium, atorvastatin calcium, midazolam hydrochloride, meperidine hydrochloride, isosorbide dinitrate, epinephrine, dopamine hydrochloride, bivalirudin, rosuvastatin, ezetimibe/simvastatin, avasimibe, cariporide.

Non-limiting examples of therapeutic agents for Psoriasis with which binding proteins of the invention can be combined include the following: small molecule inhibitor of KDR, small molecule inhibitor of Tie-2, calcipotriene, clobetasol propionate, triamcinolone acetonide, halobetasol propionate, tazarotene, methotrexate, fluocinonide, betamethasone diprop augmented, fluocinolone acetonide, acitretin, tar shampoo, betamethasone valerate, mometasone furoate, ketoconazole, pramoxine/fluocinolone, hydrocortisone valerate, flurandrenolide, urea, betamethasone, clobetasol propionate/emoll, fluticasone propionate, azithromycin, hydrocortisone, moisturizing formula, folic acid, desonide, pimecrolimus, coal tar, diflorasone diacetate, etanercept folate, lactic acid, methoxsalen, hc/bismuth subgal/znox/resor, methylprednisolone acetate, prednisone, sunscreen, halcinonide, salicylic acid, anthralin, clocortolone pivalate, coal extract, coal tar/salicylic acid, coal tar/salicylic acid/sulfur, desoximetasone, diazepam, emollient, fluocinonide/emollient, mineral oil/castor oil/na lact, mineral oil/peanut oil, petroleum/isopropyl myristate, psoralen, salicylic acid, soap/tribromsalan, thimerosal/boric acid, celecoxib, infliximab, cyclosporine, alefacept, efalizumab, tacrolimus, pimecrolimus, PUVA, UVB, sulfasalazine.

Non-limiting examples of therapeutic agents for Psoriatic Arthritis with which binding proteins of the invention can be combined include the following: methotrexate, etanercept, rofecoxib, celecoxib, folic acid, sulfasalazine, naproxen, leflunomide, methylprednisolone acetate, indomethacin, hydroxychloroquine sulfate, prednisone, sulindac, betamethasone diprop augmented, infliximab, methotrexate, folate, triamcinolone acetonide, diclofenac, dimethylsulfoxide, piroxicam, diclofenac sodium, ketoprofen, meloxicam, methylprednisolone, nabumetone, tolmetin sodium, calcipotriene, cyclosporine, diclofenac sodium/misoprostol, fluocinonide, glucosamine sulfate, gold sodium thiomalate, hydrocodone bitartrate/apap, ibuprofen, risedronate sodium, sulfadiazine, thioguanine, valdecoxib, alefacept, efalizumab and bcl-2 inhibitors.

Non-limiting examples of therapeutic agents for Restenosis with which binding proteins of the invention can be combined include the following: sirolimus, paclitaxel, everolimus, tacrolimus, Zotarolimus, acetaminophen.

Non-limiting examples of therapeutic agents for Sciatica with which binding proteins of the invention can be combined include the following: hydrocodone bitartrate/apap, rofecoxib, cyclobenzaprine hcl, methylprednisolone, naproxen, ibuprofen, oxycodone hcl/acetaminophen, celecoxib, valdecoxib, methylprednisolone acetate, prednisone, codeine phosphate/apap, tramadol hcl/acetaminophen, metaxalone, meloxicam, methocarbamol, lidocaine hydrochloride, diclofenac sodium, gabapentin, dexamethasone, carisoprodol, ketorolac tromethamine, indomethacin, acetaminophen, diazepam, nabumetone, oxycodone hcl, tizanidine hcl, diclofenac sodium/misoprostol, propoxyphene napsylate/apap, asa/oxycod/oxycodone ter, ibuprofen/hydrocodone bit, tramadol hcl, etodolac, propoxyphene hcl, amitriptyline hcl, carisoprodol/codeine phos/asa, morphine sulfate, multivitamins, naproxen sodium, orphenadrine citrate, temazepam.

Examples of therapeutic agents for SLE (Lupus) in which binding proteins of the invention can be combined include the following: NSAIDS, for example, diclofenac, naproxen, ibuprofen, piroxicam, indomethacin; COX2 inhibitors, for example, Celecoxib, rofecoxib, valdecoxib; anti-malarials, for example, hydroxychloroquine; Steroids, for example, prednisone, prednisolone, budenoside, dexamethasone; Cytotoxics, for example, azathioprine, cyclophosphamide, mycophenolate mofetil, methotrexate; inhibitors of PDE4 or purine synthesis inhibitor, for example Cellcept. Binding proteins of the invention, may also be combined with agents such as sulfasalazine, 5-aminosalicylic acid, olsalazine, Imuran and agents which interfere with synthesis, production or action of proinflammatory cytokines such as IL-1, for example, caspase inhibitors like IL-1β converting enzyme inhibitors and IL-1ra. Binding proteins of the invention may also be used with T cell signaling inhibitors, for example, tyrosine kinase inhibitors; or molecules that target T cell activation molecules, for example, CTLA-4-IgG or anti-B7 family antibodies, anti-PD-1 family antibodies. Binding proteins of the invention, can be combined with IL-11 or anticytokine antibodies, for example, fonotolizumab (anti-IFNg antibody), or anti-receptor receptor antibodies, for example, anti-IL-6 receptor antibody and antibodies to B-cell surface molecules. Antibodies of the invention or antigen binding portion thereof may also be used with LJP 394 (abetimus), agents that deplete or inactivate B-cells, for example, Rituximab (anti-CD20 antibody), lymphostat-B (anti-BlyS antibody), TNF antagonists, for example, anti-TNF antibodies, Adalimumab (PCT Publication No. WO 97/29131; HUMIRA), CA2 (REMICADE), CDP 571, TNFR-Ig constructs, (p75TNFRIgG (ENBREL) and p55TNFRIgG (LENERCEPT)) and bcl-2 inhibitors, because bcl-2 overexpression in transgenic mice has been demonstrated to cause a lupus like phenotype (see Marquina, Regina et al., Journal of Immunology (2004), 172(11), 7177-7185), therefore inhibition is expected to have therapeutic effects.

The pharmaceutical compositions of the invention may include a "therapeutically effective amount" or a "prophylactically effective amount" of a binding protein of the invention. A "therapeutically effective amount" refers to an amount effective, at dosages and for periods of time necessary, to achieve the desired therapeutic result. A therapeutically effective amount of the binding protein may be determined by a person skilled in the art and may vary according to factors such as the disease state, age, sex, and weight of the individual, and the ability of the binding protein to elicit a desired response in the individual. A therapeutically effective amount is also one in which any toxic or detrimental effects of the antibody, or antibody portion, are outweighed by the therapeutically beneficial effects. A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

Dosage regimens may be adjusted to provide the optimum desired response (e.g., a therapeutic or prophylactic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the mammalian subjects to be treated; each unit containing a predetermined quantity of active compound calculated to produce the desired therapeutic effect in association with the required pharmaceutical carrier. The specification for the dosage unit forms of the invention are dictated by and directly dependent on (a) the unique characteristics of the active compound and the particular therapeutic or prophylactic effect to be achieved, and (b) the limitations inherent in the art of compounding such an active compound for the treatment of sensitivity in individuals.

An exemplary, non-limiting range for a therapeutically or prophylactically effective amount of a binding protein of the invention is 0.1-20 mg/kg, for example, 1-10 mg/kg. It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the claimed composition.

It will be readily apparent to those skilled in the art that other suitable modifications and adaptations of the methods of the invention described herein are obvious and may be made using suitable equivalents without departing from the scope of the invention or the embodiments disclosed herein. Having now described the present invention in detail, the same will be more clearly understood by reference to the following examples, which are included for purposes of illustration only and are not intended to be limiting of the invention.

V. Diagnostics

The disclosure herein also provides diagnostic applications. This is further elucidated below.

I. Method of Assay

The present disclosure also provides a method for determining the presence, amount or concentration of an analyte (or a fragment thereof) in a test sample using at least one DVD-Ig as described herein. Any suitable assay as is known in the art can be used in the method. Examples include, but are not limited to, immunoassay, such as sandwich immunoassay (e.g., monoclonal, polyclonal and/or DVD-Ig sandwich immunoassays or any variation thereof (e.g., monoclonal/DVD-Ig, DVD-Ig/polyclonal, etc.), including radioisotope detection (radioimmunoassay (RIA)) and enzyme detection (enzyme immunoassay (EIA) or enzyme-linked immunosorbent assay (ELISA) (e.g., Quantikine ELISA assays, R&D Systems, Minneapolis, Minn.))), competitive inhibition immunoassay (e.g., forward and reverse), fluorescence polarization immunoassay (FPIA), enzyme multiplied immunoassay technique (EMIT), bioluminescence resonance energy transfer (BRET), and homogeneous chemiluminescent assay, etc. In a SELDI-based immunoassay, a capture reagent that specifically binds an analyte (or a fragment thereof) of interest is attached to the surface of a mass spectrometry probe, such as a pre-activated protein chip array. The analyte (or a fragment thereof) is then specifically captured on the biochip, and the captured analyte (or a fragment thereof) is detected by mass spectrometry. Alternatively, the analyte (or a fragment thereof) can be eluted from the capture reagent and detected by traditional MALDI (matrix-assisted laser desorption/ionization) or by SELDI. A chemiluminescent microparticle immunoassay, in particular one employing the ARCHITECT® automated analyzer (Abbott Laboratories, Abbott Park, Ill.), is an example of a preferred immunoassay.

Methods well-known in the art for collecting, handling and processing urine, blood, serum and plasma, and other body fluids, are used in the practice of the present disclosure, for instance, when a DVD-Ig as described herein is employed as an immunodiagnostic reagent and/or in an analyte immunoassay kit. The test sample can comprise further moieties in addition to the analyte of interest, such as antibodies, antigens, haptens, hormones, drugs, enzymes, receptors, proteins, peptides, polypeptides, oligonucleotides and/or polynucleotides. For example, the sample can be a whole blood sample obtained from a subject. It can be necessary or desired that a test sample, particularly whole blood, be treated prior to immunoassay as described herein, e.g., with a pretreatment reagent. Even in cases where pretreatment is not necessary (e.g., most urine samples), pretreatment optionally can be done (e.g., as part of a regimen on a commercial platform).

The pretreatment reagent can be any reagent appropriate for use with the immunoassay and kits of the invention. The pretreatment optionally comprises: (a) one or more solvents (e.g., methanol and ethylene glycol) and optionally, salt, (b) one or more solvents and salt, and optionally, detergent, (c) detergent, or (d) detergent and salt. Pretreatment reagents are known in the art, and such pretreatment can be employed, e.g., as used for assays on Abbott TDx, AxSYM®, and ARCHITECT® analyzers (Abbott Laboratories, Abbott Park, Ill.), as described in the literature (see, e.g., Yatscoff et al., Abbott TDx Monoclonal Antibody Assay Evaluated for Measuring Cyclosporine in Whole Blood, Clin. Chem. 36: 1969-1973 (1990), and Wallemacq et al., Evaluation of the New AxSYM Cyclosporine Assay: Comparison with TDx Monoclonal Whole Blood and EMIT Cyclosporine Assays, Clin. Chem. 45: 432-435 (1999)), and/or as commercially available. Additionally, pretreatment can be done as described in Abbott's U.S. Pat. No. 5,135,875, European Pat. Pub. No. 0 471 293, U.S. Provisional Pat. App. 60/878,017, filed Dec. 29, 2006, and U.S. Pat. App. Pub. No. 2008/0020401 (incorporated by reference in its entirety for its teachings regarding pretreatment). The pretreatment reagent can be a heterogeneous agent or a homogeneous agent.

With use of a heterogeneous pretreatment reagent, the pretreatment reagent precipitates analyte binding protein (e.g., protein that can bind to an analyte or a fragment thereof) present in the sample. Such a pretreatment step comprises removing any analyte binding protein by separating from the precipitated analyte binding protein the supernatant of the mixture formed by addition of the pretreatment agent to sample. In such an assay, the supernatant of the mixture absent any binding protein is used in the assay, proceeding directly to the antibody capture step.

With use of a homogeneous pretreatment reagent there is no such separation step. The entire mixture of test sample and pretreatment reagent are contacted with a labeled specific binding partner for analyte (or a fragment thereof), such as a labeled anti-analyte antibody (or an antigenically reactive fragment thereof). The pretreatment reagent employed for such an assay typically is diluted in the pretreated test sample mixture, either before or during capture by the first specific binding partner. Despite such dilution, a certain amount of the pretreatment reagent is still present (or remains) in the test sample mixture during capture. According to the invention, the labeled specific binding partner can be a DVD-Ig (or a fragment, a variant, or a fragment of a variant thereof).

In a heterogeneous format, after the test sample is obtained from a subject, a first mixture is prepared. The mixture contains the test sample being assessed for an analyte (or a fragment thereof) and a first specific binding partner, wherein the first specific binding partner and any analyte contained in the test sample form a first specific binding partner-analyte complex. Preferably, the first specific binding partner is an anti-analyte antibody or a fragment thereof. The first specific binding partner can be a DVD-Ig (or a fragment, a variant, or a fragment of a variant thereof) as described herein. The order in which the test sample and the first specific binding partner are added to form the mixture is not critical. Preferably, the first specific binding partner is immobilized on a solid phase. The solid phase used in the immunoassay (for the first specific binding partner and, optionally, the second specific binding partner) can be any solid phase known in the art, such as, but not limited to, a magnetic particle, a bead, a test tube, a microtiter plate, a cuvette, a membrane, a scaffolding molecule, a film, a filter paper, a disc and a chip.

After the mixture containing the first specific binding partner-analyte complex is formed, any unbound analyte is removed from the complex using any technique known in the art. For example, the unbound analyte can be removed by washing. Desirably, however, the first specific binding partner is present in excess of any analyte present in the test sample, such that all analyte that is present in the test sample is bound by the first specific binding partner.

After any unbound analyte is removed, a second specific binding partner is added to the mixture to form a first specific binding partner-analyte-second specific binding partner complex. The second specific binding partner is preferably an anti-analyte antibody that binds to an epitope on analyte that differs from the epitope on analyte bound by the first specific binding partner. Moreover, also preferably, the second specific binding partner is labeled with or contains a detectable label as described above. The second specific binding partner can be a DVD-Ig (or a fragment, a variant, or a fragment of a variant thereof) as described herein.

Any suitable detectable label as is known in the art can be used. For example, the detectable label can be a radioactive label (such as $^{3}H$, $^{125}I$, $^{35}S$, $^{14}C$, $^{32}P$, and $^{33}P$), an enzymatic label (such as horseradish peroxidase, alkaline peroxidase, glucose 6-phosphate dehydrogenase, and the like), a chemiluminescent label (such as acridinium esters, thioesters, or sulfonamides; luminol, isoluminol, phenanthridinium esters, and the like), a fluorescent label (such as fluorescein (e.g., 5-fluorescein, 6-carboxyfluorescein, 3'6-carboxyfluorescein, 5(6)-carboxyfluorescein, 6-hexachloro-fluorescein, 6-tetrachlorofluorescein, fluorescein isothiocyanate, and the like)), rhodamine, phycobiliproteins, R-phycoerythrin, quantum dots (e.g., zinc sulfide-capped cadmium selenide), a thermometric label, or an immuno-polymerase chain reaction label. An introduction to labels, labeling procedures and detection of labels is found in Polak and Van Noorden, *Introduction to Immunocytochemistry*, $2^{nd}$ ed., Springer Verlag, N.Y. (1997), and in Haugland, *Handbook of Fluorescent Probes and Research Chemicals* (1996), which is a combined handbook and catalogue published by Molecular Probes, Inc., Eugene, Oreg. A fluorescent label can be used in FPIA (see, e.g., U.S. Pat. Nos. 5,593,896, 5,573,904, 5,496,925, 5,359,093, and 5,352,803, which are hereby incorporated by reference in their entireties). An acridinium compound can be used as a detectable label in a homogeneous or heterogeneous chemiluminescent assay (see, e.g., Adamczyk et al., Bioorg. Med. Chem. Lett. 16: 1324-1328 (2006); Adamczyk et al., Bioorg. Med. Chem. Lett. 4: 2313-2317 (2004); Adamczyk et al., Biorg. Med. Chem. Lett. 14: 3917-3921 (2004); and Adamczyk et al., Org. Lett. 5: 3779-3782 (2003)).

A preferred acridinium compound is an acridinium-9-carboxamide. Methods for preparing acridinium 9-carboxamides are described in Mattingly, J. Biolumin. Chemilumin. 6: 107-114 (1991); Adamczyk et al., J. Org. Chem. 63: 5636-5639 (1998); Adamczyk et al., Tetrahedron 55: 10899-10914 (1999); Adamczyk et al., Org. Lett. 1: 779-781 (1999); Adamczyk et al., Bioconjugate Chem. 11: 714-724 (2000); Mattingly et al., In *Luminescence Biotechnology: Instruments and Applications*; Dyke, K. V. Ed.; CRC Press: Boca Raton, pp. 77-105 (2002); Adamczyk et al., Org. Lett. 5: 3779-3782 (2003); and U.S. Pat. Nos. 5,468,646, 5,543,524 and 5,783,699 (each of which is incorporated herein by reference in its entirety for its teachings regarding same). Another preferred acridinium compound is an acridinium-9-carboxylate aryl ester. An example of an acridinium-9-carboxylate aryl ester is 10-methyl-9-(phenoxycarbonyl)acridinium fluorosulfonate (available from Cayman Chemical, Ann Arbor, Mich.). Methods for preparing acridinium 9-carboxylate aryl esters are described in McCapra et al., Photochem. Photobiol. 4: 1111-21 (1965); Razavi et al., Luminescence 15: 245-249 (2000); Razavi et al., Luminescence 15: 239-244 (2000); and U.S. Pat. No. 5,241,070 (each of which is incorporated herein by reference in its entirety for its teachings regarding same). Further details regarding acridinium-9-carboxylate aryl ester and its use are set forth in US 2008-0248493.

Chemiluminescent assays (e.g., using acridinium as described above or other chemiluminescent agents) can be performed in accordance with the methods described in Adamczyk et al., Anal. Chim. Acta 579(1): 61-67 (2006). While any suitable assay format can be used, a microplate chemiluminometer (Mithras LB-940, Berthold Technologies U.S.A., LLC, Oak Ridge, Tenn.) enables the assay of multiple samples of small volumes rapidly.

The order in which the test sample and the specific binding partner(s) are added to form the mixture for chemiluminescent assay is not critical. If the first specific binding partner is detectably labeled with a chemiluminescent agent such as an acridinium compound, detectably labeled first specific binding partner-analyte complexes form. Alternatively, if a second specific binding partner is used and the second specific binding partner is detectably labeled with a chemiluminescent agent such as an acridinium compound, detectably labeled first specific binding partner-analyte-second specific binding partner complexes form. Any unbound specific binding partner, whether labeled or unlabeled, can be removed from the mixture using any technique known in the art, such as washing.

Hydrogen peroxide can be generated in situ in the mixture or provided or supplied to the mixture (e.g., the source of the hydrogen peroxide being one or more buffers or other solutions that are known to contain hydrogen peroxide) before, simultaneously with, or after the addition of an above-described acridinium compound. Hydrogen peroxide can be generated in situ in a number of ways such as would be apparent to one skilled in the art.

Upon the simultaneous or subsequent addition of at least one basic solution to the sample, a detectable signal, namely, a chemiluminescent signal, indicative of the presence of analyte is generated. The basic solution contains at least one base and has a pH greater than or equal to 10, preferably, greater than or equal to 12. Examples of basic solutions include, but are not limited to, sodium hydroxide, potassium hydroxide, calcium hydroxide, ammonium hydroxide, magnesium hydroxide, sodium carbonate, sodium bicarbonate, calcium hydroxide, calcium carbonate, and calcium bicarbonate. The amount of basic solution added to the sample depends on the concentration of the basic solution. Based on the concentration of the basic solution used, one skilled in the art can easily determine the amount of basic solution to add to the sample.

The chemiluminescent signal that is generated can be detected using routine techniques known to those skilled in the art. Based on the intensity of the signal generated, the amount of analyte in the sample can be quantified. Specifically, the amount of analyte in the sample is proportional to the intensity of the signal generated. The amount of analyte present can be quantified by comparing the amount of light generated to a standard curve for analyte or by comparison to a reference standard. The standard curve can be generated using serial dilutions or solutions of known concentrations of analyte by mass spectroscopy, gravimetric methods, and other techniques known in the art. While the above is described with emphasis on use of an acridinium compound as the chemiluminescent agent, one of ordinary skill in the art can readily adapt this description for use of other chemiluminescent agents.

Analyte immunoassays generally can be conducted using any format known in the art, such as, but not limited to, a sandwich format. Specifically, in one immunoassay format, at least two antibodies are employed to separate and quantify analyte, such as human analyte, or a fragment thereof in a sample. More specifically, the at least two antibodies bind to different epitopes on an analyte (or a fragment thereof) forming an immune complex, which is referred to as a "sandwich." Generally, in the immunoassays one or more antibodies can be used to capture the analyte (or a fragment thereof) in the test sample (these antibodies are frequently referred to as a "capture" antibody or "capture" antibodies) and one or more antibodies can be used to bind a detectable (namely, quantifiable) label to the sandwich (these antibodies are frequently referred to as the "detection antibody," the "detection antibodies," the "conjugate," or the "conjugates"). Thus, in the context of a sandwich immunoassay format, a DVD-Ig (or a fragment, a variant, or a fragment of a variant thereof) as described herein can be used as a capture antibody, a detection antibody, or both. For example, one DVD-Ig having a domain that can bind a first epitope on an analyte (or a fragment thereof) can be used as a capture antibody and/or another DVD-Ig having a domain that can bind a second epitope on an analyte (or a fragment thereof) can be used as a detection antibody. In this regard, a DVD-Ig having a first domain that can bind a first epitope on an analyte (or a fragment thereof) and a second domain that can bind a second epitope on an analyte (or a fragment thereof) can be used as a capture antibody and/or a detection antibody. Alternatively, one DVD-Ig having a first domain that can bind an epitope on a first analyte (or a fragment thereof) and a second domain that can bind an epitope on a second analyte (or a fragment thereof) can be used as a capture antibody and/or a detection antibody to detect, and optionally quantify, two or more analytes. In the event that an analyte can be present in a sample in more than one form, such as a monomeric form and a dimeric/multimeric form, which can be homomeric or heteromeric, one DVD-Ig having a domain that can bind an epitope that is only exposed on the monomeric form and another DVD-Ig having a domain that can bind an epitope on a different part of a dimeric/multimeric form can be used as capture antibodies and/or detection antibodies, thereby enabling the detection, and optional quantification, of different forms of a given analyte. Furthermore, employing DVD-Igs with differential affinities within a single DVD-Ig and/or between DVD-Igs can provide an avidity advantage. In the context of immunoassays as described herein, it generally may be helpful or desired to incorporate one or more linkers within the structure of a DVD-Ig. When present, optimally the linker should be of sufficient length and structural flexibility to enable binding of an epitope by the inner domains as well as binding of another epitope by the outer domains. In this regard, if a DVD-Ig can bind two different analytes and one analyte is larger than the other, desirably the larger analyte is bound by the outer domains.

Generally speaking, a sample being tested for (for example, suspected of containing) analyte (or a fragment thereof) can be contacted with at least one capture antibody (or antibodies) and at least one detection antibody (which can be a second detection antibody or a third detection antibody or even a successively numbered antibody, e.g., as where the capture and/or detection antibody comprise multiple antibodies) either simultaneously or sequentially and in any order. For example, the test sample can be first contacted with at least one capture antibody and then (sequentially) with at least one detection antibody. Alternatively, the test sample can be first contacted with at least one detection antibody and then (sequentially) with at least one capture antibody. In yet another alternative, the test sample can be contacted simultaneously with a capture antibody and a detection antibody.

In the sandwich assay format, a sample suspected of containing analyte (or a fragment thereof) is first brought into contact with at least one first capture antibody under conditions that allow the formation of a first antibody/analyte complex. If more than one capture antibody is used, a first capture antibody/analyte complex comprising two or more capture antibodies is formed. In a sandwich assay, the antibodies, i.e., preferably, the at least one capture antibody, are used in molar excess amounts of the maximum amount of analyte (or a fragment thereof) expected in the test sample. For example, from about 5 µg to about 1 mg of antibody per mL of buffer (e.g., microparticle coating buffer) can be used.

Competitive inhibition immunoassays, which are often used to measure small analytes because binding by only one antibody is required, comprise sequential and classic formats. In a sequential competitive inhibition immunoassay a capture antibody to an analyte of interest is coated onto a well of a microtiter plate or other solid support. When the sample containing the analyte of interest is added to the well, the analyte of interest binds to the capture antibody. After washing, a known amount of labeled (e.g., biotin or horseradish peroxidase (HRP)) analyte is added to the well. A substrate for an enzymatic label is necessary to generate a signal. An example of a suitable substrate for HRP is 3,3',5,5'-tetramethylbenzidine (TMB). After washing, the signal generated by the labeled analyte is measured and is inversely proportional to the amount of analyte in the sample. In a classic competitive inhibition immunoassay an antibody to an analyte of interest is coated onto a solid support (e.g., a well of a microtiter plate). However, unlike the sequential competitive inhibition immunoassay, the sample and the labeled analyte are added to the well at the same time. Any analyte in the sample competes with labeled analyte for binding to the capture antibody. After washing, the signal generated by the labeled analyte is measured and is inversely proportional to the amount of analyte in the sample.

Optionally, prior to contacting the test sample with the at least one capture antibody (for example, the first capture antibody), the at least one capture antibody can be bound to a solid support, which facilitates the separation of the first antibody/analyte (or a fragment thereof) complex from the test sample. The substrate to which the capture antibody is bound can be any suitable solid support or solid phase that facilitates separation of the capture antibody-analyte complex from the sample.

Examples include a well of a plate, such as a microtiter plate, a test tube, a porous gel (e.g., silica gel, agarose, dextran, or gelatin), a polymeric film (e.g., polyacrylamide), beads (e.g., polystyrene beads or magnetic beads), a strip of a filter/membrane (e.g., nitrocellulose or nylon), microparticles (e.g., latex particles, magnetizable microparticles (e.g., microparticles having ferric oxide or chromium oxide cores and homo- or hetero-polymeric coats and radii of about 1-10 microns). The substrate can comprise a suitable porous material with a suitable surface affinity to bind antigens and sufficient porosity to allow access by detection antibodies. A microporous material is generally preferred, although a gelatinous material in a hydrated state can be used. Such porous substrates are preferably in the form of sheets having a thickness of about 0.01 to about 0.5 mm, preferably about 0.1 mm. While the pore size may vary quite a bit, preferably the pore size is from about 0.025 to about 15 microns, more preferably from about 0.15 to about 15 microns. The surface of such substrates can be activated by chemical processes that cause covalent linkage of an antibody to the substrate. Irreversible binding, generally by adsorption through hydrophobic forces, of the antigen or the antibody to the substrate results; alternatively, a chemical coupling agent or other means can be used to bind covalently the antibody to the substrate, provided that such binding does not interfere with the ability of the antibody to bind to analyte. Alternatively, the antibody can be bound with microparticles, which have been previously coated with streptavidin (e.g., DYNAL® Magnetic Beads, Invitrogen, Carlsbad, Calif.) or biotin (e.g., using Power-Bind™-SA-MP streptavidin-coated microparticles (Seradyn, Indianapolis, Ind.)) or anti-species-specific monoclonal antibodies. If necessary, the substrate can be derivatized to allow reactivity with various functional groups on the antibody. Such derivatization requires the use of certain coupling agents, examples of which include, but are not limited to, maleic anhydride, N-hydroxysuccinimide, and 1-ethyl-3-(3-dimethylaminopropyl) carbodiimide. If desired, one or more capture reagents, such as antibodies (or fragments thereof), each of which is specific for analyte(s) can be attached to solid phases in different physical or addressable locations (e.g., such as in a biochip configuration (see, e.g., U.S. Pat. No. 6,225,047; Int'l Pat. App. Pub. No. WO 99/51773; U.S. Pat. No. 6,329,209; Int'l Pat. App. Pub. No. WO 00/56934, and U.S. Pat. No. 5,242,828). If the capture reagent is attached to a mass spectrometry probe as the solid support, the amount of analyte bound to the probe can be detected by laser desorption ionization mass spectrometry. Alternatively, a single column can be packed with different beads, which are derivatized with the one or more capture reagents, thereby capturing the analyte in a single place (see, antibody-derivatized, bead-based technologies, e.g., the xMAP technology of Luminex (Austin, Tex.)).

After the test sample being assayed for analyte (or a fragment thereof) is brought into contact with the at least one capture antibody (for example, the first capture antibody), the mixture is incubated in order to allow for the formation of a first antibody (or multiple antibody)-analyte (or a fragment thereof) complex. The incubation can be carried out at a pH of from about 4.5 to about 10.0, at a temperature of from about 2° C. to about 45° C., and for a period from at least about one (1) minute to about eighteen (18) hours, preferably from about 1 to about 24 minutes, most preferably for about 4 to about 18 minutes. The immunoassay described herein can be conducted in one step (meaning the test sample, at least one capture antibody and at least one detection antibody are all added sequentially or simultaneously to a reaction vessel) or in more than one step, such as two steps, three steps, etc.

After formation of the (first or multiple) capture antibody/analyte (or a fragment thereof) complex, the complex is then contacted with at least one detection antibody under conditions which allow for the formation of a (first or multiple) capture antibody/analyte (or a fragment thereof)/second detection antibody complex). While captioned for clarity as the "second" antibody (e.g., second detection antibody), in fact, where multiple antibodies are used for capture and/or detection, the at least one detection antibody can be the second, third, fourth, etc. antibodies used in the immunoassay. If the capture antibody/analyte (or a fragment thereof) complex is contacted with more than one detection antibody, then a (first or multiple) capture antibody/analyte (or a fragment thereof)/(multiple) detection antibody complex is formed. As with the capture antibody (e.g., the first capture antibody), when the at least one (e.g., second and any subsequent) detection antibody is brought into contact with the capture antibody/analyte (or a fragment thereof) complex, a period of incubation under conditions similar to those described above is required for the formation of the (first or multiple) capture antibody/analyte (or a fragment thereof)/(second or multiple) detection antibody complex. Preferably, at least one detection antibody contains a detectable label. The detectable label can be bound to the at least one detection antibody (e.g., the second detection antibody) prior to, simultaneously with, or after the formation of the (first or multiple) capture antibody/analyte (or a fragment thereof)/(second or multiple) detection antibody complex. Any detectable label known in the art can be used (see discussion above, including of the Polak and Van Noorden (1997) and Haugland (1996) references).

The detectable label can be bound to the antibodies either directly or through a coupling agent. An example of a coupling agent that can be used is EDAC (1-ethyl-3-(3-dimethylaminopropyl) carbodiimide, hydrochloride), which is commercially available from Sigma-Aldrich, St. Louis, Mo. Other coupling agents that can be used are known in the art. Methods for binding a detectable label to an antibody are known in the art. Additionally, many detectable labels can be purchased or synthesized that already contain end groups that facilitate the coupling of the detectable label to the antibody, such as CPSP-Acridinium Ester (i.e., 9-[N-tosyl-N-(3-carboxypropyl)]-10-(3-sulfopropyl)acridinium carboxamide) or SPSP-Acridinium Ester (i.e., N10-(3-sulfopropyl)-N-(3-sulfopropyl)-acridinium-9-carboxamide).

The (first or multiple) capture antibody/analyte/(second or multiple) detection antibody complex can be, but does not have to be, separated from the remainder of the test sample prior to quantification of the label. For example, if the at least one capture antibody (e.g., the first capture antibody) is bound to a solid support, such as a well or a bead, separation can be accomplished by removing the fluid (of the test sample) from contact with the solid support. Alternatively, if the at least first capture antibody is bound to a solid support, it can be simultaneously contacted with the analyte-containing sample and the at least one second detection antibody to form a first (multiple) antibody/analyte/second (multiple) antibody complex, followed by removal of the fluid (test sample) from contact with the solid support. If the at least one first capture antibody is not bound to a solid support, then the (first or multiple) capture antibody/analyte/(second or multiple) detection antibody complex does not have to be removed from the test sample for quantification of the amount of the label.

After formation of the labeled capture antibody/analyte/detection antibody complex (e.g., the first capture antibody/analyte/second detection antibody complex), the amount of label in the complex is quantified using techniques known in the art. For example, if an enzymatic label is used, the labeled complex is reacted with a substrate for the label that gives a quantifiable reaction such as the development of color. If the label is a radioactive label, the label is quantified using appropriate means, such as a scintillation counter. If the label is a fluorescent label, the label is quantified by stimulating the label with a light of one color (which is known as the "excitation wavelength") and detecting another color (which is known as the "emission wavelength") that is emitted by the label in response to the stimulation. If the label is a chemiluminescent label, the label is quantified by detecting the light emitted either visually or by using luminometers, x-ray film, high speed photographic film, a CCD camera, etc. Once the amount of the label in the complex has been quantified, the concentration of analyte or a fragment thereof in the test sample is determined by appropriate means, such as by use of a standard curve that has been generated using serial dilutions of analyte or a fragment thereof of known concentration. Other than using serial dilutions of analyte or a fragment thereof, the standard curve can be generated gravimetrically, by mass spectroscopy and by other techniques known in the art.

In a chemiluminescent microparticle assay employing the ARCHITECT® analyzer, the conjugate diluent pH should be about 6.0+/−0.2, the microparticle coating buffer should be maintained at about room temperature (i.e., at from about 17 to about 27° C.), the microparticle coating buffer pH should be about 6.5+/−0.2, and the microparticle diluent pH should be about 7.8+/−0.2. Solids preferably are less than about 0.2%, such as less than about 0.15%, less than about 0.14%, less than about 0.13%, less than about 0.12%, or less than about 0.11%, such as about 0.10%.

FPIAs are based on competitive binding immunoassay principles. A fluorescently labeled compound, when excited by a linearly polarized light, will emit fluorescence having a degree of polarization inversely proportional to its rate of rotation. When a fluorescently labeled tracer-antibody complex is excited by a linearly polarized light, the emitted light remains highly polarized because the fluorophore is constrained from rotating between the time light is absorbed and the time light is emitted. When a "free" tracer compound (i.e., a compound that is not bound to an antibody) is excited by linearly polarized light, its rotation is much faster than the corresponding tracer-antibody conjugate produced in a competitive binding immunoassay. FPIAs are advantageous over RIAs inasmuch as there are no radioactive substances requiring special handling and disposal. In addition, FPIAs are homogeneous assays that can be easily and rapidly performed.

In view of the above, a method of determining the presence, amount, or concentration of analyte (or a fragment thereof) in a test sample is provided. The method comprises assaying the test sample for an analyte (or a fragment thereof) by an assay (i) employing (i') at least one of an antibody, a fragment of an antibody that can bind to an analyte, a variant of an antibody that can bind to an analyte, a fragment of a variant of an antibody that can bind to an analyte, and a DVD-Ig (or a fragment, a variant, or a fragment of a variant thereof) that can bind to an analyte, and (ii') at least one detectable label and (ii) comprising comparing a signal generated by the detectable label as a direct or indirect indication of the presence, amount or concentration of analyte (or a fragment thereof) in the test sample to a signal generated as a direct or indirect indication of the presence, amount or concentration of analyte (or a fragment thereof) in a control or calibrator. The calibrator is optionally part of a series of calibrators, in which each of the calibrators differs from the other calibrators by the concentration of analyte.

The method can comprise (i) contacting the test sample with at least one first specific binding partner for analyte (or a fragment thereof) selected from the group consisting of an antibody, a fragment of an antibody that can bind to an analyte, a variant of an antibody that can bind to an analyte, a fragment of a variant of an antibody that can bind to an analyte, and a DVD-Ig (or a fragment, a variant, or a fragment of a variant thereof) that can bind to an analyte so as to form a first specific binding partner/analyte (or fragment thereof) complex, (ii) contacting the first specific binding partner/analyte (or fragment thereof) complex with at least one second specific binding partner for analyte (or fragment thereof) selected from the group consisting of a detectably labeled anti-analyte antibody, a detectably labeled fragment of an anti-analyte antibody that can bind to analyte, a detectably labeled variant of an anti-analyte antibody that can bind to analyte, a detectably labeled fragment of a variant of an anti-analyte antibody that can bind to analyte, and a detectably labeled DVD-Ig (or a fragment, a variant, or a fragment of a variant thereof) so as to form a first specific binding partner/analyte (or fragment thereof)/second specific binding partner complex, and (iii) determining the presence, amount or concentration of analyte in the test sample by detecting or measuring the signal generated by the detectable label in the first specific binding partner/analyte (or fragment thereof)/second specific binding partner complex formed in (ii). A method in which at least one first specific binding partner for analyte (or a fragment thereof) and/or at least one second specific binding partner for analyte (or a fragment thereof) is a DVD-Ig (or a fragment, a variant, or a fragment of a variant thereof) as described herein can be preferred.

Alternatively, the method can comprise contacting the test sample with at least one first specific binding partner for analyte (or a fragment thereof) selected from the group consisting of an antibody, a fragment of an antibody that can bind to an analyte, a variant of an antibody that can bind to an analyte, a fragment of a variant of an antibody that can bind to an analyte, and a DVD-Ig (or a fragment, a variant, or a fragment of a variant thereof) and simultaneously or sequentially, in either order, contacting the test sample with at least one second specific binding partner, which can compete with analyte (or a fragment thereof) for binding to the at least one first specific binding partner and which is selected from the group consisting of a detectably labeled analyte, a detectably labeled fragment of analyte that can bind to the first specific binding partner, a detectably labeled variant of analyte that can bind to the first specific binding partner, and a detectably labeled fragment of a variant of analyte that can bind to the first specific binding partner. Any analyte (or a fragment thereof) present in the test sample and the at least one second specific binding partner compete with each other to form a first specific binding partner/analyte (or fragment thereof) complex and a first specific binding partner/second specific binding partner complex, respectively. The method further comprises determining the presence, amount or concentration of analyte in the test sample by detecting or measuring the signal generated by the detectable label in the first specific binding partner/second specific binding partner complex formed in (ii), wherein the signal generated by the detectable label in the first specific binding partner/second specific binding partner complex is inversely proportional to the amount or concentration of analyte in the test sample.

The above methods can further comprise diagnosing, prognosticating, or assessing the efficacy of a therapeutic/prophylactic treatment of a patient from whom the test sample was obtained. If the method further comprises assessing the efficacy of a therapeutic/prophylactic treatment of the patient from whom the test sample was obtained, the method optionally further comprises modifying the therapeutic/prophylactic treatment of the patient as needed to improve efficacy. The method can be adapted for use in an automated system or a semi-automated system.

With regard to the methods of assay (and kit therefor), it may be possible to employ commercially available anti-analyte antibodies or methods for production of anti-analyte as described in the literature. Commercial supplies of various antibodies include, but are not limited to, Santa Cruz Biotechnology Inc. (Santa Cruz, Calif.), GenWay Biotech, Inc. (San Diego, Calif.), and R&D Systems (RDS; Minneapolis, Minn.).

Generally, a predetermined level can be employed as a benchmark against which to assess results obtained upon assaying a test sample for analyte or a fragment thereof, e.g., for detecting disease or risk of disease. Generally, in making such a comparison, the predetermined level is obtained by running a particular assay a sufficient number of times and under appropriate conditions such that a linkage or association of analyte presence, amount or concentration with a particular stage or endpoint of a disease, disorder or condition or with particular clinical indicia can be made. Typically, the predetermined level is obtained with assays of reference subjects (or populations of subjects). The analyte measured can include fragments thereof, degradation products thereof, and/or enzymatic cleavage products thereof.

In particular, with respect to a predetermined level as employed for monitoring disease progression and/or treatment, the amount or concentration of analyte or a fragment thereof may be "unchanged," "favorable" (or "favorably altered"), or "unfavorable" (or "unfavorably altered"). "Elevated" or "increased" refers to an amount or a concentration in a test sample that is higher than a typical or normal level or range (e.g., predetermined level), or is higher than another reference level or range (e.g., earlier or baseline sample). The term "lowered" or "reduced" refers to an amount or a concentration in a test sample that is lower than a typical or normal level or range (e.g., predetermined level), or is lower than another reference level or range (e.g., earlier or baseline sample). The term "altered" refers to an amount or a concentration in a sample that is altered (increased or decreased) over a typical or normal level or range (e.g., predetermined level), or over another reference level or range (e.g., earlier or baseline sample).

The typical or normal level or range for analyte is defined in accordance with standard practice. Because the levels of analyte in some instances will be very low, a so-called altered level or alteration can be considered to have occurred when there is any net change as compared to the typical or normal level or range, or reference level or range, that cannot be explained by experimental error or sample variation. Thus, the level measured in a particular sample will be compared with the level or range of levels determined in similar samples from a so-called normal subject. In this context, a "normal subject" is an individual with no detectable disease, for example, and a "normal" (sometimes termed "control") patient or population is/are one(s) that exhibit(s) no detectable disease, respectively, for example. Furthermore, given that analyte is not routinely found at a high level in the majority of the human population, a "normal subject" can be considered an individual with no substantial detectable increased or elevated amount or concentration of analyte, and a "normal" (sometimes termed "control") patient or population is/are one(s) that exhibit(s) no substantial detectable increased or elevated amount or concentration of analyte. An "apparently normal subject" is one in which analyte has not yet been or currently is being assessed. The level of an analyte is said to be "elevated" when the analyte is normally undetectable (e.g., the normal level is zero, or within a range of from about 25 to about 75 percentiles of normal populations), but is detected in a test sample, as well as when the analyte is present in the test sample at a higher than normal level. Thus, inter alia, the disclosure provides a method of screening for a subject having, or at risk of having, a particular disease, disorder, or condition. The method of assay can also involve the assay of other markers and the like.

Accordingly, the methods described herein also can be used to determine whether or not a subject has or is at risk of developing a given disease, disorder or condition. Specifically, such a method can comprise the steps of:

(a) determining the concentration or amount in a test sample from a subject of analyte (or a fragment thereof) (e.g., using the methods described herein, or methods known in the art); and (b) comparing the concentration or amount of analyte (or a fragment thereof) determined in step (a) with a predetermined level, wherein, if the concentration or amount of analyte determined in step (a) is favorable with respect to a predetermined level, then the subject is determined not to have or be at risk for a given disease, disorder or condition. However, if the concentration or amount of analyte determined in step (a) is unfavorable with respect to the predetermined level, then the subject is determined to have or be at risk for a given disease, disorder or condition.

Additionally, provided herein is method of monitoring the progression of disease in a subject. Optimally the method comprising the steps of:

(a) determining the concentration or amount in a test sample from a subject of analyte;

(b) determining the concentration or amount in a later test sample from the subject of analyte; and (c) comparing the concentration or amount of analyte as determined in step (b) with the concentration or amount of analyte determined in step (a), wherein if the concentration or amount determined in step (b) is unchanged or is unfavorable when compared to the concentration or amount of analyte determined in step (a), then the disease in the subject is determined to have continued, progressed or worsened. By comparison, if the concentration or amount of analyte as determined in step (b) is favorable when compared to the concentration or amount of analyte as determined in step (a), then the disease in the subject is determined to have discontinued, regressed or improved.

Optionally, the method further comprises comparing the concentration or amount of analyte as determined in step (b), for example, with a predetermined level. Further, optionally the method comprises treating the subject with one or more pharmaceutical compositions for a period of time if the comparison shows that the concentration or amount of analyte as determined in step (b), for example, is unfavorably altered with respect to the predetermined level.

Still further, the methods can be used to monitor treatment in a subject receiving treatment with one or more pharmaceutical compositions. Specifically, such methods involve providing a first test sample from a subject before the subject has been administered one or more pharmaceutical compositions. Next, the concentration or amount in a first test sample from a subject of analyte is determined (e.g., using the methods described herein or as known in the art). After the concentration or amount of analyte is determined, optionally the concentration or amount of analyte is then compared with a predetermined level. If the concentration or amount of analyte as determined in the first test sample is lower than the predetermined level, then the subject is not treated with one or more pharmaceutical compositions. However, if the concentration or amount of analyte as determined in the first test sample is higher than the predetermined level, then the subject is treated with one or more pharmaceutical compositions for a period of time. The period of time that the subject is treated with the one or more pharmaceutical compositions can be determined by one skilled in the art (for example, the period of time can be from about seven (7) days to about two years, preferably from about fourteen (14) days to about one (1) year).

During the course of treatment with the one or more pharmaceutical compositions, second and subsequent test samples are then obtained from the subject. The number of test samples and the time in which said test samples are obtained from the subject are not critical. For example, a second test sample could be obtained seven (7) days after the subject is first administered the one or more pharmaceutical compositions, a third test sample could be obtained two (2) weeks after the subject is first administered the one or more pharmaceutical compositions, a fourth test sample could be obtained three (3) weeks after the subject is first administered the one or more pharmaceutical compositions, a fifth test sample could be obtained four (4) weeks after the subject is first administered the one or more pharmaceutical compositions, etc.

After each second or subsequent test sample is obtained from the subject, the concentration or amount of analyte is determined in the second or subsequent test sample is determined (e.g., using the methods described herein or as known in the art). The concentration or amount of analyte as determined in each of the second and subsequent test samples is then compared with the concentration or amount of analyte as determined in the first test sample (e.g., the test sample that was originally optionally compared to the predetermined level). If the concentration or amount of analyte as determined in step (c) is favorable when compared to the concentration or amount of analyte as determined in step (a), then the disease in the subject is determined to have discontinued, regressed or improved, and the subject should continue to be administered the one or pharmaceutical compositions of step (b). However, if the concentration or amount determined in step (c) is unchanged or is unfavorable when compared to the concentration or amount of analyte as determined in step (a), then the disease in the subject is determined to have continued, progressed or worsened, and the subject should be treated with a higher concentration of the one or more pharmaceutical compositions administered to the subject in step (b) or the subject should be treated with one or more pharmaceutical compositions that are different from the one or more pharmaceutical compositions administered to the subject in step (b). Specifically, the subject can be treated with one or more pharmaceutical compositions that are different from the one or more pharmaceutical compositions that the subject had previously received to decrease or lower said subject's analyte level.

Generally, for assays in which repeat testing may be done (e.g., monitoring disease progression and/or response to treatment), a second or subsequent test sample is obtained at a period in time after the first test sample has been obtained from the subject. Specifically, a second test sample from the subject can be obtained minutes, hours, days, weeks or years after the first test sample has been obtained from the subject.

For example, the second test sample can be obtained from the subject at a time period of about 1 minute, about 5 minutes, about 10 minutes, about 15 minutes, about 30 minutes, about 45 minutes, about 60 minutes, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days, about 7 days, about 2 weeks, about 3 weeks, about 4 weeks, about 5 weeks, about 6 weeks, about 7 weeks, about 8 weeks, about 9 weeks, about 10 weeks, about 11 weeks, about 12 weeks, about 13 weeks, about 14 weeks, about 15 weeks, about 16 weeks, about 17 weeks, about 18 weeks, about 19 weeks, about 20 weeks, about 21 weeks, about 22 weeks, about 23 weeks, about 24 weeks, about 25 weeks, about 26 weeks, about 27 weeks, about 28 weeks, about 29 weeks, about 30 weeks, about 31 weeks, about 32 weeks, about 33 weeks, about 34 weeks, about 35 weeks, about 36 weeks, about 37 weeks, about 38 weeks, about 39 weeks, about 40 weeks, about 41 weeks, about 42 weeks, about 43 weeks, about 44 weeks, about 45 weeks, about 46 weeks, about 47 weeks, about 48 weeks, about 49 weeks, about 50 weeks, about 51 weeks, about 52 weeks, about 1.5 years, about 2 years, about 2.5 years, about 3.0 years, about 3.5 years, about 4.0 years, about 4.5 years, about 5.0 years, about 5.5 years, about 6.0 years, about 6.5 years, about 7.0 years, about 7.5 years, about 8.0 years, about 8.5 years, about 9.0 years, about 9.5 years or about 10.0 years after the first test sample from the subject is obtained.

When used to monitor disease progression, the above assay can be used to monitor the progression of disease in subjects suffering from acute conditions. Acute conditions, also known as critical care conditions, refer to acute, life-threatening diseases or other critical medical conditions involving, for example, the cardiovascular system or excretory system. Typically, critical care conditions refer to those conditions requiring acute medical intervention in a hospital-based setting (including, but not limited to, the emergency room, intensive care unit, trauma center, or other emergent care setting) or administration by a paramedic or other field-based medical personnel. For critical care conditions, repeat monitoring is generally done within a shorter time frame, namely, minutes, hours or days (e.g., about 1 minute, about 5 minutes, about 10 minutes, about 15 minutes, about 30 minutes, about 45 minutes, about 60 minutes, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days or about 7 days), and the initial assay likewise is generally done within a shorter timeframe, e.g., about minutes, hours or days of the onset of the disease or condition.

The assays also can be used to monitor the progression of disease in subjects suffering from chronic or non-acute conditions. Non-critical care or, non-acute conditions, refers to conditions other than acute, life-threatening disease or other critical medical conditions involving, for example, the cardiovascular system and/or excretory system. Typically, non-acute conditions include those of longer-term or chronic duration. For non-acute conditions, repeat monitoring generally is done with a longer timeframe, e.g., hours, days, weeks, months or years (e.g., about 1 hour, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days, about 7 days, about 2 weeks, about 3 weeks, about 4 weeks, about 5 weeks, about 6 weeks, about 7 weeks, about 8 weeks, about 9 weeks, about 10 weeks, about 11 weeks, about 12 weeks, about 13 weeks, about 14 weeks, about 15 weeks, about 16 weeks, about 17 weeks, about 18 weeks, about 19 weeks, about 20 weeks, about 21 weeks, about 22 weeks, about 23 weeks, about 24 weeks, about 25 weeks, about 26 weeks, about 27 weeks, about 28 weeks, about 29 weeks, about 30 weeks, about 31 weeks, about 32 weeks, about 33 weeks, about 34 weeks, about 35 weeks, about 36 weeks, about 37 weeks, about 38 weeks, about 39 weeks, about 40 weeks, about 41 weeks, about 42 weeks, about 43 weeks, about 44 weeks, about 45 weeks, about 46 weeks, about 47 weeks, about 48 weeks, about 49 weeks, about 50 weeks, about 51 weeks, about 52 weeks, about 1.5 years, about 2 years, about 2.5 years, about 3.0 years, about 3.5 years, about 4.0 years, about 4.5 years, about 5.0 years, about 5.5 years, about 6.0 years, about 6.5 years, about 7.0 years, about 7.5 years, about 8.0 years, about 8.5 years, about 9.0 years, about 9.5 years or about 10.0 years), and the initial assay likewise generally is done within a longer time frame, e.g., about hours, days, months or years of the onset of the disease or condition.

Furthermore, the above assays can be performed using a first test sample obtained from a subject where the first test sample is obtained from one source, such as urine, serum or plasma. Optionally, the above assays can then be repeated using a second test sample obtained from the subject where the second test sample is obtained from another source. For example, if the first test sample was obtained from urine, the second test sample can be obtained from serum or plasma. The results obtained from the assays using the first test sample and the second test sample can be compared. The comparison can be used to assess the status of a disease or condition in the subject.

Moreover, the present disclosure also relates to methods of determining whether a subject predisposed to or suffering from a given disease, disorder or condition will benefit from treatment. In particular, the disclosure relates to analyte companion diagnostic methods and products. Thus, the method of "monitoring the treatment of disease in a subject" as described herein further optimally also can encompass selecting or identifying candidates for therapy.

Thus, in particular embodiments, the disclosure also provides a method of determining whether a subject having, or at risk for, a given disease, disorder or condition is a candidate for therapy. Generally, the subject is one who has experienced some symptom of a given disease, disorder or condition or who has actually been diagnosed as having, or being at risk for, a given disease, disorder or condition, and/or who demonstrates an unfavorable concentration or amount of analyte or a fragment thereof, as described herein.

The method optionally comprises an assay as described herein, where analyte is assessed before and following treatment of a subject with one or more pharmaceutical compositions (e.g., particularly with a pharmaceutical related to a mechanism of action involving analyte), with immunosuppressive therapy, or by immunoabsorption therapy, or where analyte is assessed following such treatment and the concentration or the amount of analyte is compared against a predetermined level. An unfavorable concentration of amount of analyte observed following treatment confirms that the subject will not benefit from receiving further or continued treatment, whereas a favorable concentration or amount of analyte observed following treatment confirms that the subject will benefit from receiving further or continued treatment. This confirmation assists with management of clinical studies, and provision of improved patient care.

It goes without saying that, while certain embodiments herein are advantageous when employed to assess a given disease, disorder or condition as discussed herein, the assays and kits can be employed to assess analyte in other diseases, disorders and conditions. The method of assay can also involve the assay of other markers and the like.

The method of assay also can be used to identify a compound that ameliorates a given disease, disorder or condition. For example, a cell that expresses analyte can be contacted with a candidate compound. The level of expression of analyte in the cell contacted with the compound can be compared to that in a control cell using the method of assay described herein.

II. Kit

A kit for assaying a test sample for the presence, amount or concentration of an analyte (or a fragment thereof) in a test sample is also provided. The kit comprises at least one component for assaying the test sample for the analyte (or a fragment thereof) and instructions for assaying the test sample for the analyte (or a fragment thereof). The at least one component for assaying the test sample for the analyte (or a fragment thereof) can include a composition comprising an anti-analyte DVD-Ig (or a fragment, a variant, or a fragment of a variant thereof), which is optionally immobilized on a solid phase.

The kit can comprise at least one component for assaying the test sample for an analyte by immunoassay, e.g., chemiluminescent microparticle immunoassay, and instructions for assaying the test sample for an analyte by immunoassay, e.g., chemiluminescent microparticle immunoassay. For example, the kit can comprise at least one specific binding partner for an analyte, such as an anti-analyte, monoclonal/polyclonal antibody (or a fragment thereof that can bind to the analyte, a variant thereof that can bind to the analyte, or a fragment of a variant that can bind to the analyte) or an anti-analyte DVD-Ig (or a fragment, a variant, or a fragment of a variant thereof), either of which can be detectably labeled. Alternatively or additionally, the kit can comprise detectably labeled analyte (or a fragment thereof that can bind to an anti-analyte, monoclonal/polyclonal antibody or an anti-analyte DVD-Ig (or a fragment, a variant, or a fragment of a variant thereof)), which can compete with any analyte in a test sample for binding to an anti-analyte, monoclonal/polyclonal antibody (or a fragment thereof that can bind to the analyte, a variant thereof that can bind to the analyte, or a fragment of a variant that can bind to the analyte) or an anti-analyte DVD-Ig (or a fragment, a variant, or a fragment of a variant thereof), either of which can be immobilized on a solid support. The kit can comprise a calibrator or control, e.g., isolated or purified analyte. The kit can comprise at least one container (e.g., tube, microtiter plates or strips, which can be already coated with a first specific binding partner, for example) for conducting the assay, and/or a buffer, such as an assay buffer or a wash buffer, either one of which can be provided as a concentrated solution, a substrate solution for the detectable label (e.g., an enzymatic label), or a stop solution. Preferably, the kit comprises all components, i.e., reagents, standards, buffers, diluents, etc., which are necessary to perform the assay. The instructions can be in paper form or computer-readable form, such as a disk, CD, DVD, or the like.

Any antibodies, such as an anti-analyte antibody or an anti-analyte DVD-Ig, or tracer can incorporate a detectable label as described herein, such as a fluorophore, a radioactive moiety, an enzyme, a biotin/avidin label, a chromophore, a chemiluminescent label, or the like, or the kit can include reagents for carrying out detectable labeling. The antibodies, calibrators and/or controls can be provided in separate containers or pre-dispensed into an appropriate assay format, for example, into microtiter plates.

Optionally, the kit includes quality control components (for example, sensitivity panels, calibrators, and positive controls). Preparation of quality control reagents is well-known in the art and is described on insert sheets for a variety of immunodiagnostic products. Sensitivity panel members optionally are used to establish assay performance characteristics, and further optionally are useful indicators of the integrity of the immunoassay kit reagents, and the standardization of assays.

The kit can also optionally include other reagents required to conduct a diagnostic assay or facilitate quality control evaluations, such as buffers, salts, enzymes, enzyme co-factors, enzyme substrates, detection reagents, and the like. Other components, such as buffers and solutions for the isolation and/or treatment of a test sample (e.g., pretreatment reagents), also can be included in the kit. The kit can additionally include one or more other controls. One or more of the components of the kit can be lyophilized, in which case the kit can further comprise reagents suitable for the reconstitution of the lyophilized components.

The various components of the kit optionally are provided in suitable containers as necessary, e.g., a microtiter plate. The kit can further include containers for holding or storing a sample (e.g., a container or cartridge for a urine sample). Where appropriate, the kit optionally also can contain reaction vessels, mixing vessels, and other components that facilitate the preparation of reagents or the test sample. The kit can also include one or more instruments for assisting with obtaining a test sample, such as a syringe, pipette, forceps, measured spoon, or the like.

If the detectable label is at least one acridinium compound, the kit can comprise at least one acridinium-9-carboxamide, at least one acridinium-9-carboxylate aryl ester, or any combination thereof. If the detectable label is at least one acridinium compound, the kit also can comprise a source of hydrogen peroxide, such as a buffer, a solution, and/or at least one basic solution. If desired, the kit can contain a solid phase, such as a magnetic particle, bead, test tube, microtiter plate, cuvette, membrane, scaffolding molecule, film, filter paper, disc or chip.

III. Adaptation of Kit and Method

The kit (or components thereof), as well as the method of determining the presence, amount or concentration of an analyte in a test sample by an assay, such as an immunoassay as described herein, can be adapted for use in a variety of automated and semi-automated systems (including those wherein the solid phase comprises a microparticle), as described, e.g., in U.S. Pat. Nos. 5,089,424 and 5,006,309, and as commercially marketed, e.g., by Abbott Laboratories (Abbott Park, Ill.) as ARCHITECT®.

Some of the differences between an automated or semi-automated system as compared to a non-automated system (e.g., ELISA) include the substrate to which the first specific binding partner (e.g., an anti-analyte, monoclonal/polyclonal antibody (or a fragment thereof, a variant thereof, or a fragment of a variant thereof) or an anti-analyte DVD-Ig (or a fragment thereof, a variant thereof, or a fragment of a variant thereof) is attached; either way, sandwich formation and analyte reactivity can be impacted), and the length and timing of the capture, detection and/or any optional wash steps. Whereas a non-automated format, such as an ELISA, may require a relatively longer incubation time with sample and capture reagent (e.g., about 2 hours), an automated or semi-automated format (e.g., ARCHITECT®, Abbott Laboratories) may have a relatively shorter incubation time (e.g., approximately 18 minutes for ARCHITECT®). Similarly, whereas a non-automated format, such as an ELISA, may incubate a detection antibody, such as the conjugate reagent, for a relatively longer incubation time (e.g., about 2 hours), an automated or semi-automated format (e.g., ARCHITECT®) may have a relatively shorter incubation time (e.g., approximately 4 minutes for the ARCHITECT®).

Other platforms available from Abbott Laboratories include, but are not limited to, AxSYM®, IMx® (see, e.g., U.S. Pat. No. 5,294,404, which is hereby incorporated by reference in its entirety), PRISM®, EIA (bead), and Quantum™ II, as well as other platforms. Additionally, the assays, kits and kit components can be employed in other formats, for example, on electrochemical or other hand-held or point-of-care assay systems. The present disclosure is, for example, applicable to the commercial Abbott Point of Care (i-STAT®, Abbott Laboratories) electrochemical immunoassay system that performs sandwich immunoassays Immunosensors and their methods of manufacture and operation in single-use test devices are described, for example in, U.S. Pat. No. 5,063,081, U.S. Pat. App. Pub. No. 2003/0170881, U.S. Pat. App. Pub. No. 2004/0018577, U.S. Pat. App. Pub. No. 2005/0054078, and U.S. Pat. App. Pub. No. 2006/0160164, which are incorporated in their entireties by reference for their teachings regarding same.

In particular, with regard to the adaptation of an analyte assay to the I-STAT® system, the following configuration is preferred. A microfabricated silicon chip is manufactured with a pair of gold amperometric working electrodes and a silver-silver chloride reference electrode. On one of the working electrodes, polystyrene beads (0.2 mm diameter) with immobilized anti-analyte, monoclonal/polyclonal antibody (or a fragment thereof, a variant thereof, or a fragment of a variant thereof) or anti-analyte DVD-Ig (or a fragment thereof, a variant thereof, or a fragment of a variant thereof), are adhered to a polymer coating of patterned polyvinyl alcohol over the electrode. This chip is assembled into an I-STAT® cartridge with a fluidics format suitable for immunoassay. On a portion of the wall of the sample-holding chamber of the cartridge there is a layer comprising a specific binding partner for an analyte, such as an anti-analyte, monoclonal/polyclonal antibody (or a fragment thereof, a variant thereof, or a fragment of a variant thereof that can bind the analyte) or an anti-analyte DVD-Ig (or a fragment thereof, a variant thereof, or a fragment of a variant thereof that can bind the analyte), either of which can be detectably labeled. Within the fluid pouch of the cartridge is an aqueous reagent that includes p-aminophenol phosphate.

In operation, a sample suspected of containing an analyte is added to the holding chamber of the test cartridge, and the cartridge is inserted into the I-STAT® reader. After the specific binding partner for an analyte has dissolved into the sample, a pump element within the cartridge forces the sample into a conduit containing the chip. Here it is oscillated to promote formation of the sandwich. In the penultimate step of the assay, fluid is forced out of the pouch and into the conduit to wash the sample off the chip and into a waste chamber. In the final step of the assay, the alkaline phosphatase label reacts with p-aminophenol phosphate to cleave the phosphate group and permit the liberated p-aminophenol to be electrochemically oxidized at the working electrode. Based on the measured current, the reader is able to calculate the amount of analyte in the sample by means of an embedded algorithm and factory-determined calibration curve.

It further goes without saying that the methods and kits as described herein necessarily encompass other reagents and methods for carrying out the immunoassay. For instance, encompassed are various buffers such as are known in the art and/or which can be readily prepared or optimized to be employed, e.g., for washing, as a conjugate diluent, microparticle diluent, and/or as a calibrator diluent. An exemplary conjugate diluent is ARCHITECT® conjugate diluent employed in certain kits (Abbott Laboratories, Abbott Park, Ill.) and containing 2-(N-morpholino)ethanesulfonic acid (MES), a salt, a protein blocker, an antimicrobial agent, and a detergent. An exemplary calibrator diluent is ARCHITECT® human calibrator diluent employed in certain kits (Abbott Laboratories, Abbott Park, Ill.), which comprises a buffer containing MES, other salt, a protein blocker, and an antimicrobial agent. Additionally, as described in U.S. Patent Application No. 61/142,048 filed Dec. 31, 2008, improved signal generation may be obtained, e.g., in an I-Stat cartridge format, using a nucleic acid sequence linked to the signal antibody as a signal amplifier.

EXEMPLIFICATION

Example 1

Design, Construction, and Analysis of a DVD-Ig

Example 1.1

Assays Used to Identify and Characterize Parent Antibodies and DVD-Ig

The following assays were used throughout the Examples to identify and characterize parent antibodies and DVD-Ig, unless otherwise stated.

Example 1.1.1

Assays Used to Determine Binding and Affinity of Parent Antibodies and DVD-Ig for Their Target Antigen(s)

Example 1.1.1A

Direct Bind ELISA

Enzyme Linked Immunosorbent Assays to screen for antibodies that bind a desired target antigen were performed as follows. High bind ELISA plates (Corning Costar #3369, Acton, Mass.) were coated with 100 µL/well of 10 µg/ml of desired target antigen (R&D Systems, Minneapolis, Minn.) or desired target antigen extra-cellular domain/FC fusion protein (R&D Systems, Minneapolis, Minn.) or monoclonal mouse anti-polyHistidine antibody (R&D Systems # MAB050, Minneapolis, Minn.) in phosphate buffered saline (10×PBS, Abbott Bioresearch Center, Media Prep# MPS-073, Worcester, Mass.) overnight at 4° C. Plates were washed four times with PBS containing 0.02% Tween 20. Plates were blocked by the addition of 300 µL/well blocking solution (non-fat dry milk powder, various retail suppliers, diluted to 2% in PBS) for ½ hour at room temperature. Plates were washed four times after blocking with PBS containing 0.02% Tween 20.

Alternatively, one hundred microliters per well of 10 μg/ml of Histidine (His) tagged desired target antigen (R&D Systems, Minneapolis, Minn.) was added to ELISA plates coated with monoclonal mouse anti-polyHistidine antibody as described above and incubated for 1 hour at room temperature. Wells were washed four times with PBS containing 0.02% Tween 20.

One hundred microliters of antibody or DVD-Ig preparations diluted in blocking solution as described above was added to the desired target antigen plate or desired target antigen/FC fusion plate or the anti-polyHistidine antibody/His tagged desired target antigen plate prepared as described above and incubated for 1 hour at room temperature. Wells are washed four times with PBS containing 0.02% Tween 20.

One hundred microliters of 10 ng/mL goat anti-human IgG FC specific HRP conjugated antibody (Southern Biotech #2040-05, Birmingham, Ala.) was added to each well of the desired target antigen plate or anti-polyHistidine antibody/Histidine tagged desired target antigen plate. Alternatively, one hundred microliters of 10 ng/mL goat anti-human IgG kappa light chain specific HRP conjugated antibody (Southern Biotech #2060-05 Birmingham, Ala.) was added to each well of the desired target antigen/FC fusion plate and incubated for 1 hour at room temperature. Plates were washed 4 times with PBS containing 0.02% Tween 20.

One hundred microliters of enhanced TMB solution (Neogen Corp. #308177, K Blue, Lexington, Ky.) was added to each well and incubated for 10 minutes at room temperature. The reaction was stopped by the addition of 50 μL 1N sulphuric acid. Plates were read spectrophotometrically at a wavelength of 450 nm.

Table 3 contains a list of the antigens used in the Direct Bind Assay.

Table 4 contains the binding data expressed as EC50 in nM for those antibodies and DVD-Ig constructs tested in the Direct Bind ELISA assay.

In the Direct Bind ELISA, binding was sometimes not observed, probably because the antibody binding site on the target antigen was either "masked" or the antigen is "distorted" when coated to the plastic surface. The inability of a DVD-Ig to bind its target may also be due to steric limitation imposed on DVD-Ig by the Direct Bind ELISA format. The parent antibodies and DVD-Igs that did not bind in the Direct Bind ELISA format bound to target antigen in other ELISA formats, such as FACS, Biacore or bioassay. Non-binding of a DVD-Ig was also restored by adjusting the linker length between the two variable domains of the DVD-Ig, as shown previously.

TABLE 3

Antigens Used in Direct Bind ELISA

| Assay | Antigen | Vendor Designation | Vendor | Catalog # |
|---|---|---|---|---|
| CD-22 | CD22/FC | Siglec-2 ECD/FC chimera | R&D | 1968-SL-050 |
| CD-40 | CD40/FC | CD40 ECD/FC chimera-His tag | R&D | 1493-CD-050 |
| CD-80 | CD80/FC | B7-1 ECD/FC chimera | R&D | 140-B1-100 |
| DLL4 | DLL4 | DLL4 ECD/His tag | R&D | 1506-D4-050 |
| EGFR | EGFR/FC | EGFR ECD/FC chimera | R&D | 344-ER-050 |
| HER-2 | HER-2/FC | ErbB2 ECD/FC chimera-His tag | R&D | 1129-ER-050 |
| HGF | HGF | HGF-His tag | R&D | 294-HG-025 |
| IGF1 | IGF1 | IGF-I | R&D | 291-G1-050 |

TABLE 3-continued

Antigens Used in Direct Bind ELISA

| Assay | Antigen | Vendor Designation | Vendor | Catalog # |
|---|---|---|---|---|
| IGF2 | IGF2 | IGF-2 | R&D | 292-G2-050 |
| IGF1R | IGF1R | IGF1R ECD | R&D | 391-GR-050 |
| NRP1 | NRP1 | Neuropilin-1 Npn-1-His tag | R&D | 3870-N1-025 |
| PlGF | PlGF | Placental GF | R&D | 264-PG-050 |
| RON | RON | MSP Receptor ECD-His tag | R&D | 1947-MS-050 |
| VEGF | VEGF | VEGF 1-165 aa | R&D | 293-VE-010 |
| ErbB3 | ErbB3 | ErbB3 ECD/FC Chimera-His tag | R&D | 348-RB-050 |

ECD = Extracellular Domain
/FC chimera = antigen/IgG FC domain fusion protein

TABLE 4

Direct Bind ELISA Of Parent Antibodies And DVD-Ig Constructs

| Parent Antibody or DVD-Ig ID | N-terminal Variable Domain (VD) | C-terminal Variable Domain (VD) | Direct Bind ELISA N-terminal VD EC50 (nM) | Direct Bind ELISA C-terminal VD EC50 (nM) |
|---|---|---|---|---|
| AB006 | CD-19 | | | 0.04 |
| AB001 | CD-20 | | | |
| DVD001 | CD-20 | CD-19 | | 12.93 |
| DVD002 | CD-19 | CD-20 | 0.07 | |
| AB007 | CD-80 | | | 0.77 |
| AB001 | CD-20 | | | |
| DVD005 | CD-20 | CD-80 | | 9.77 |
| DVD006 | CD-80 | CD-20 | 1.09 | |
| AB008 | CD-22 | | | 3.44 |
| AB001 | CD-20 | | | |
| DVD007 | CD-20 | CD-22 | | 30.54 |
| DVD008 | CD-22 | CD-20 | 4.79 | |
| AB009 | CD-40 | | | 0.99 |
| AB001 | CD-20 | | | |
| DVD009 | CD-20 | CD-40 | | 3.55 |
| DVD010 | CD-40 | CD-20 | 0.82 | |
| AB002 | CD-3 | | | |
| AB004 | HER-2 | | | 0.15 |
| DVD011 | CD-3 | HER-2 | | 6.63 |
| DVD012 | HER-2 | CD-3 | 1.24 | |
| AB002 | CD-3 | | | |
| AB006 | CD-19 | | | 0.14 |
| DVD013 | CD-3 | CD-19 | | 7.29 |
| DVD014 | CD-19 | CD-3 | 0.12 | |
| AB033 | EGFR | | | 0.66 |
| AB004 | HER-2 | | | 1.9 |
| DVD015 | EGFR | HER-2 | 0.41 | 148.48 |
| DVD016 | HER-2 | EGFR | 1.25 | 5.23 |
| AB002 | CD-3 | | | |
| AB033 | EGFR | | | 0.28 |
| DVD017 | EGFR | CD-3 | 0.3 | |
| DVD018 | CD-3 | EGFR | | 1.93 |
| AB033 | EGFR | | | 0.27 |
| AB011 | IGF1R | | | 0.28 |
| DVD021 | EGFR | IGF1R | 0.33 | 134.95 |
| DVD022 | IGF1R | EGFR | 0.26 | 0.74 |
| AB005 | RON | | | 0.26 |
| AB033 | EGFR | | | 0.28 |
| DVD023 | EGFR | RON | 0.23 | 40.18 |
| DVD024 | RON | EGFR | 0.54 | 1.87 |
| AB033 | EGFR | | | 0.27 |
| AB012 | HGF | | | 0.22 |
| DVD025 | EGFR | HGF | 0.31 | 251.45 |
| DVD026 | HGF | EGFR | 0.33 | 7.89 |
| AB004 | HER-2 | | | 0.44 |
| AB010 | IGF1, 2 | | | 4.77/10.02 |
| DVD029 | HER-2 | IGF1/IGF2 | 1226.04 | 229.33/206.12 |
| DVD030 | IGF1/IGF2 | HER-2 | 1.75/5.49 | 10.65 |
| AB004 | HER-2 | | | 0.15 |
| AB011 | IGF1R | | | 0.28 |
| DVD031 | HER-2 | IGF1R | 0.28 | 171.04 |

TABLE 4-continued

Direct Bind ELISA Of Parent Antibodies And DVD-Ig Constructs

| Parent Antibody or DVD-Ig ID | N-terminal Variable Domain (VD) | C-terminal Variable Domain (VD) | Direct Bind ELISA N-terminal VD EC50 (nM) | Direct Bind ELISA C-terminal VD EC50 (nM) |
|---|---|---|---|---|
| DVD032 | IGF1R | HER-2 | 0.16 | 11.03 |
| AB005 | RON | | 0.21 | |
| AB012 | HGF | | | 0.19 |
| DVD033 | RON | HGF | 0.22 | 11.95 |
| DVD034 | HGF | RON | 0.27 | 116.46 |
| AB014 | VEGF | | 0.87 | |
| AB033 | EGFR | | | 0.28 |
| DVD035 | VEGF | EGFR | 0.74 | 1.24 |
| DVD036 | EGFR | VEGF | 0.18 | 336.13 |
| AB014 | VEGF | | 2.71 | |
| AB004 | HER-2 | | | 0.15 |
| DVD037 | VEGF | HER-2 | 1.86 | 1.44 |
| DVD038 | HER-2 | VEGF | 0.66 | 106.77 |
| AB001 | CD-20 | | | |
| AB014 | VEGF | | 2.71 | |
| DVD039 | VEGF | CD-20 | 1.27 | |
| DVD040 | CD-20 | VEGF | | 71.18 |
| AB014 | VEGF | | 0.87 | |
| AB010 | IGF1, 2 | | | 4.77/18.13 |
| DVD041 | VEGF | IGF1/IGF2 | 0.68 | 381.18/7335.24 |
| DVD042 | IGF1/IGF2 | VEGF | 2.54/17.62 | 42.3 |
| AB015 | DLL-4 | | 0.31 | |
| AB014 | VEGF | | 2.71 | |
| DVD043 | VEGF | DLL4 | 28.25 | 2.12 |
| DVD044 | DLL4 | VEGF | 0.53 | 10.88 |
| AB014 | VEGF | | 2.95 | |
| AB012 | HGF | | | 0.19 |
| DVD045 | VEGF | HGF | 2.87 | 184.53 |
| DVD046 | HGF | VEGF | 0.5 | 46.3 |
| AB005 | RON | | 0.26 | |
| AB014 | VEGF | | 2.95 | |
| DVD047 | VEGF | RON | 19.2 | 94.82 |
| DVD048 | RON | VEGF | 0.46 | 42.95 |
| AB014 | VEGF | | 2.95 | |
| AB016 | NRP1 | | | 0.58 |
| DVD049 | VEGF | NRP1 | 1.71 | 0.5 |
| DVD050 | NRP1 | VEGF | 0.46 | 219.02 |
| AB015 | DLL-4 | | 0.31 | |
| AB047 | PlGF | | | 0.2 |
| DVD257 | DLL4 | PlGF | 0.28 | 2 |
| DVD258 | PlGF | DLL4 | 0.08 | 2.3 |
| AB014 | VEGF | | | 1.09 |
| AB047 | PlGF | | | 0.2 |
| DVD259 | VEGF | PlGF | 0.79 | 1.3 |
| DVD260 | PlGF | VEGF | 0.12 | 19.06 |
| AB062 | ErbB3 | | | 1.93 |
| AB033 | EGFR | | | 0.68 |
| DVD299 | ErbB3 | EGFR | 1.96 | 17.38 |
| DVD300 | EGFR | ErbB3 | 0.49 | 7633.3 |
| AB063 | ErbB3 | | | 0.28 |
| AB033 | EGFR | | | 0.68 |
| DVD305 | ErbB3 | EGFR | 0.44 | 24.39 |
| DVD306 | EGFR | ErbB3 | 0.36 | 150.92 |

Binding of all DVD-Ig constructs was maintained and comparable to that of parent antibodies. All N-terminal variable domains bound with a similar high affinity as the parent antibody as well as the C-terminal variable domains of DVD-Ig constructs DVD009, DVD016, DVD018, DVD022, DVD024, DVD035, DVD37, DVD043, DVD044, DVD49, DVD257, DVD258 and DVD259.

Tables 5 and 6 contain VEGF Direct Bind ELISA data for three VEGF parent antibodies and 96 DVD-Ig constructs with either C-terminal (C-term.) or N-terminal (N-term.) variable domains derived from the variable domains of the parent VEGF Reference Antibodies (Ref Ab.) AB014-VEGF (seq. 1), AB071-VEGF (seq. 2) and AB070-VEGF (seq. 3). These variable domains are paired with four DLL-4 variable domains derived from four DLL-4 Ref. Ab. (AB015-DLL-4 (seq. 1), AB069-DLL-4 (seq. 2), AB073-DLL-4 (seq. 3), and AB072-DLL-4 (seq. 4). The DVD-Ig variable domains are connected by 2 linker lengths (Short and Long in either the heavy chain (HC linker) and/or light chain (LC linker), resulting in four possible linker combinations: Short-Short, Long-Long, Short-Long and Long-Short. The combination of these 5 factors (3 VEGF sequences×2 Orientations×2 HC Linkers×2 LC Linkers×4 DLL-4 sequences) results in the full factorial experiment of 96 DVDs.

TABLE 5

Direct Bind ELISA Of 96 DVD Constructs With Various VEGF Sequences, Orientations And Linker Length Combinations To VEGF

| DVD ID | Sequence ID | Position | HC Linker | LC Linker | Other DVD Domain | DVD VEGF EC50 (nM) | Ref. Ab. ID | RefAb VEGF EC50 (nM) |
|---|---|---|---|---|---|---|---|---|
| DVD043 | VEGF (Seq. 1) | N-term. | Short | Short | DLL4 (seq. 1) | 1.25 | AB014 | 2.36 |
| DVD044 | VEGF (Seq. 1) | C-term. | Short | Short | DLL4 (seq. 1) | 407.52 | AB014 | 2.36 |
| DVD469 | VEGF (Seq. 1) | C-term. | Long | Long | DLL4 (seq. 1) | 1262.59 | AB014 | 2.36 |
| DVD470 | VEGF (Seq. 1) | N-term. | Long | Long | DLL4 (seq. 1) | 1.87 | AB014 | 2.36 |
| DVD475 | VEGF (Seq. 1) | C-term. | Long | Short | DLL4 (seq. 1) | 19.17 | AB014 | 1.51 |
| DVD476 | VEGF (Seq. 1) | N-term. | Long | Short | DLL4 (seq. 1) | 0.55 | AB014 | 1.51 |
| DVD481 | VEGF (Seq. 1) | C-term. | Short | Long | DLL4 (seq. 1) | 150.24 | AB014 | 1.51 |
| DVD482 | VEGF (Seq. 1) | N-term. | Short | Long | DLL4 (seq. 1) | 1.30 | AB014 | 1.51 |
| DVD467 | VEGF (Seq. 2) | C-term. | Short | Short | DLL4 (seq. 1) | 1805.23 | AB071 | 60.82 |
| DVD468 | VEGF (Seq. 2) | N-term. | Short | Short | DLL4 (seq. 1) | 25.55 | AB071 | 60.82 |
| DVD473 | VEGF (Seq. 2) | C-term. | Long | Long | DLL4 (seq. 1) | 388.01 | AB071 | 60.82 |
| DVD474 | VEGF (Seq. 2) | N-term. | Long | Long | DLL4 (seq. 1) | 17.93 | AB071 | 60.82 |
| DVD479 | VEGF (Seq. 2) | C-term. | Long | Short | DLL4 (seq. 1) | 455.50 | AB071 | 68.55 |
| DVD480 | VEGF (Seq. 2) | N-term. | Long | Short | DLL4 (seq. 1) | 22.98 | AB071 | 68.55 |
| DVD485 | VEGF (Seq. 2) | C-term. | Short | Long | DLL4 (seq. 1) | 121.21 | AB071 | 68.55 |
| DVD486 | VEGF (Seq. 2) | N-term. | Short | Long | DLL4 (seq. 1) | 27.96 | AB071 | 68.55 |
| DVD465 | VEGF (Seq. 3) | C-term. | Short | Short | DLL4 (seq. 1) | 396.45 | AB070 | 1.82 |
| DVD466 | VEGF (Seq. 3) | N-term. | Short | Short | DLL4 (seq. 1) | 2.61 | AB070 | 1.82 |
| DVD471 | VEGF (Seq. 3) | C-term. | Long | Long | DLL4 (seq. 1) | 30.05 | AB070 | 1.82 |
| DVD472 | VEGF (Seq. 3) | N-term. | Long | Long | DLL4 (seq. 1) | 9.22 | AB070 | 1.82 |
| DVD477 | VEGF (Seq. 3) | C-term. | Long | Short | DLL4 (seq. 1) | 41.66 | AB070 | 3.59 |
| DVD478 | VEGF (Seq. 3) | N-term. | Long | Short | DLL4 (seq. 1) | 2.72 | AB070 | 3.59 |
| DVD483 | VEGF (Seq. 3) | C-term. | Short | Long | DLL4 (seq. 1) | 46.09 | AB070 | 3.59 |

TABLE 5-continued

Direct Bind ELISA Of 96 DVD Constructs With Various VEGF Sequences, Orientations And Linker Length Combinations To VEGF

| DVD ID | Sequence ID | Position | HC Linker | LC Linker | Other DVD Domain | DVD VEGF EC50 (nM) | Ref. Ab. ID | RefAb VEGF EC50 (nM) |
|---|---|---|---|---|---|---|---|---|
| DVD484 | VEGF (Seq. 3) | N-term. | Short | Long | DLL4 (seq. 1) | 4.84 | AB070 | 3.59 |
| DVD441 | VEGF (Seq. 1) | C-term. | Short | Short | DLL4 (seq. 2) | 247.99 | AB014 | 1.52 |
| DVD442 | VEGF (Seq. 1) | N-term. | Short | Short | DLL4 (seq. 2) | 0.59 | AB014 | 1.52 |
| DVD447 | VEGF (Seq. 1) | C-term. | Long | Long | DLL4 (seq. 2) | 5.05 | AB014 | 1.52 |
| DVD448 | VEGF (Seq. 1) | N-term. | Long | Long | DLL4 (seq. 2) | 1.59 | AB014 | 1.52 |
| DVD453 | VEGF (Seq. 1) | C-term. | Long | Short | DLL4 (seq. 2) | 35.28 | AB014 | 1.50 |
| DVD454 | VEGF (Seq. 1) | N-term. | Long | Short | DLL4 (seq. 2) | 1.43 | AB014 | 1.50 |
| DVD459 | VEGF (Seq. 1) | C-term. | Short | Long | DLL4 (seq. 2) | 6.17 | AB014 | 1.50 |
| DVD460 | VEGF (Seq. 1) | N-term. | Short | Long | DLL4 (seq. 2) | 0.94 | AB014 | 1.50 |
| DVD445 | VEGF (Seq. 2) | C-term. | Short | Short | DLL4 (seq. 2) | 14482.02 | AB071 | 48.07 |
| DVD446 | VEGF (Seq. 2) | N-term. | Short | Short | DLL4 (seq. 2) | 14.38 | AB071 | 48.07 |
| DVD451 | VEGF (Seq. 2) | C-term. | Long | Long | DLL4 (seq. 2) | 2404.95 | AB071 | 48.07 |
| DVD452 | VEGF (Seq. 2) | N-term. | Long | Long | DLL4 (seq. 2) | 17.75 | AB071 | 48.07 |
| DVD457 | VEGF (Seq. 2) | C-term. | Long | Short | DLL4 (seq. 2) | 1475.74 | AB071 | 40.24 |
| DVD458 | VEGF (Seq. 2) | N-term. | Long | Short | DLL4 (seq. 2) | 21.51 | AB071 | 40.24 |
| DVD463 | VEGF (Seq. 2) | C-term. | Short | Long | DLL4 (seq. 2) | 1730.97 | AB071 | 40.24 |
| DVD464 | VEGF (Seq. 2) | N-term. | Short | Long | DLL4 (seq. 2) | 19.31 | AB071 | 40.24 |
| DVD443 | VEGF (Seq. 3) | C-term. | Short | Short | DLL4 (seq. 2) | 610.53 | AB070 | 1.05 |
| DVD444 | VEGF (Seq. 3) | N-term. | Short | Short | DLL4 (seq. 2) | 2.44 | AB070 | 1.05 |
| DVD449 | VEGF (Seq. 3) | C-term. | Long | Long | DLL4 (seq. 2) | 15.61 | AB070 | 1.05 |
| DVD450 | VEGF (Seq. 3) | N-term. | Long | Long | DLL4 (seq. 2) | 12.06 | AB070 | 1.05 |
| DVD455 | VEGF (Seq. 3) | C-term. | Long | Short | DLL4 (seq. 2) | 26.71 | AB070 | 1.11 |
| DVD456 | VEGF (Seq. 3) | N-term. | Long | Short | DLL4 (seq. 2) | 1.63 | AB070 | 1.11 |
| DVD461 | VEGF (Seq. 3) | C-term. | Short | Long | DLL4 (seq. 2) | 10.44 | AB070 | 1.11 |
| DVD462 | VEGF (Seq. 3) | N-term. | Short | Long | DLL4 (seq. 2) | 8.00 | AB070 | 1.11 |
| DVD511 | VEGF (Seq. 1) | C-term. | Short | Short | DLL4 (seq. 3) | 35.11 | AB014 | 0.75 |
| DVD512 | VEGF (Seq. 1) | N-term. | Short | Short | DLL4 (seq. 3) | 0.71 | AB014 | 0.75 |
| DVD517 | VEGF (Seq. 1) | C-term. | Long | Long | DLL4 (seq. 3) | 9.78 | AB014 | 0.75 |
| DVD518 | VEGF (Seq. 1) | N-term. | Long | Long | DLL4 (seq. 3) | 162.44 | AB014 | 0.75 |
| DVD523 | VEGF (Seq. 1) | C-term. | Long | Short | DLL4 (seq. 3) | 9.67 | AB014 | 0.49 |
| DVD524 | VEGF (Seq. 1) | N-term. | Long | Short | DLL4 (seq. 3) | 0.30 | AB014 | 0.49 |
| DVD529 | VEGF (Seq. 1) | C-term. | Short | Long | DLL4 (seq. 3) | 2.64 | AB014 | 0.49 |
| DVD530 | VEGF (Seq. 1) | N-term. | Short | Long | DLL4 (seq. 3) | 0.79 | AB014 | 0.49 |
| DVD515 | VEGF (Seq. 2) | C-term. | Short | Short | DLL4 (seq. 3) | 3015.10 | AB071 | 35.19 |
| DVD516 | VEGF (Seq. 2) | N-term. | Short | Short | DLL4 (seq. 3) | 24.65 | AB071 | 35.19 |
| DVD521 | VEGF (Seq. 2) | C-term. | Long | Long | DLL4 (seq. 3) | 654.85 | AB071 | 35.19 |
| DVD522 | VEGF (Seq. 2) | N-term. | Long | Long | DLL4 (seq. 3) | 23.53 | AB071 | 35.19 |
| DVD527 | VEGF (Seq. 2) | C-term. | Long | Short | DLL4 (seq. 3) | 2380.25 | AB071 | 52.97 |
| DVD528 | VEGF (Seq. 2) | N-term. | Long | Short | DLL4 (seq. 3) | 27.69 | AB071 | 52.97 |
| DVD533 | VEGF (Seq. 2) | C-term. | Short | Long | DLL4 (seq. 3) | 1260.61 | AB071 | 52.97 |
| DVD534 | VEGF (Seq. 2) | N-term. | Short | Long | DLL4 (seq. 3) | 23.61 | AB071 | 52.97 |
| DVD513 | VEGF (Seq. 3) | C-term. | Short | Short | DLL4 (seq. 3) | 58.54 | AB070 | 0.97 |
| DVD514 | VEGF (Seq. 3) | N-term. | Short | Short | DLL4 (seq. 3) | 67.41 | AB070 | 0.97 |
| DVD519 | VEGF (Seq. 3) | C-term. | Long | Long | DLL4 (seq. 3) | 77.17 | AB070 | 0.97 |
| DVD520 | VEGF (Seq. 3) | N-term. | Long | Long | DLL4 (seq. 3) | 247.74 | AB070 | 0.97 |
| DVD525 | VEGF (Seq. 3) | C-term. | Long | Short | DLL4 (seq. 3) | 21.79 | AB070 | 1.42 |
| DVD526 | VEGF (Seq. 3) | N-term. | Long | Short | DLL4 (seq. 3) | 96.22 | AB070 | 1.42 |
| DVD531 | VEGF (Seq. 3) | C-term. | Short | Long | DLL4 (seq. 3) | 60.39 | AB070 | 1.42 |
| DVD532 | VEGF (Seq. 3) | N-term. | Short | Long | DLL4 (seq. 3) | 28.91 | AB070 | 1.42 |
| DVD487 | VEGF (Seq. 1) | C-term. | Short | Short | DLL4 (seq. 4) | 39.78 | AB014 | 1.61 |
| DVD488 | VEGF (Seq. 1) | N-term. | Short | Short | DLL4 (seq. 4) | 4.98 | AB014 | 1.61 |
| DVD493 | VEGF (Seq. 1) | C-term. | Long | Long | DLL4 (seq. 4) | 2.26 | AB014 | 1.61 |
| DVD494 | VEGF (Seq. 1) | N-term. | Long | Long | DLL4 (seq. 4) | 712.21 | AB014 | 1.61 |
| DVD499 | VEGF (Seq. 1) | C-term. | Long | Short | DLL4 (seq. 4) | 5.07 | AB014 | 1.41 |
| DVD500 | VEGF (Seq. 1) | N-term. | Long | Short | DLL4 (seq. 4) | 5.28 | AB014 | 1.41 |
| DVD505 | VEGF (Seq. 1) | C-term. | Short | Long | DLL4 (seq. 4) | 1.27 | AB014 | 1.41 |
| DVD506 | VEGF (Seq. 1) | N-term. | Short | Long | DLL4 (seq. 4) | 1.84 | AB014 | 1.41 |
| DVD491 | VEGF (Seq. 2) | C-term. | Short | Short | DLL4 (seq. 4) | 1249.97 | AB071 | 45.67 |
| DVD492 | VEGF (Seq. 2) | N-term. | Short | Short | DLL4 (seq. 4) | 8.42 | AB071 | 45.67 |
| DVD497 | VEGF (Seq. 2) | C-term. | Long | Long | DLL4 (seq. 4) | 858.21 | AB071 | 45.67 |
| DVD498 | VEGF (Seq. 2) | N-term. | Long | Long | DLL4 (seq. 4) | 30.61 | AB071 | 45.67 |
| DVD503 | VEGF (Seq. 2) | C-term. | Long | Short | DLL4 (seq. 4) | 429.96 | AB071 | 37.84 |
| DVD504 | VEGF (Seq. 2) | N-term. | Long | Short | DLL4 (seq. 4) | 16.74 | AB071 | 37.84 |
| DVD509 | VEGF (Seq. 2) | C-term. | Short | Long | DLL4 (seq. 4) | 121.28 | AB071 | 37.84 |
| DVD510 | VEGF (Seq. 2) | N-term. | Short | Long | DLL4 (seq. 4) | 23.89 | AB071 | 37.84 |
| DVD489 | VEGF (Seq. 3) | C-term. | Short | Short | DLL4 (seq. 4) | 180.95 | AB070 | 2.80 |
| DVD490 | VEGF (Seq. 3) | N-term. | Short | Short | DLL4 (seq. 4) | 6.70 | AB070 | 2.80 |
| DVD495 | VEGF (Seq. 3) | C-term. | Long | Long | DLL4 (seq. 4) | 69.95 | AB070 | 2.80 |
| DVD496 | VEGF (Seq. 3) | N-term. | Long | Long | DLL4 (seq. 4) | 107.87 | AB070 | 2.80 |
| DVD501 | VEGF (Seq. 3) | C-term. | Long | Short | DLL4 (seq. 4) | 45.16 | AB070 | 2.44 |
| DVD502 | VEGF (Seq. 3) | N-term. | Long | Short | DLL4 (seq. 4) | 3.25 | AB070 | 2.44 |
| DVD507 | VEGF (Seq. 3) | C-term. | Short | Long | DLL4 (seq. 4) | 34.85 | AB070 | 2.44 |
| DVD508 | VEGF (Seq. 3) | N-term. | Short | Long | DLL4 (seq. 4) | 7.88 | AB070 | 2.44 |

Binding of all DVD-Ig constructs to VEGF was maintained and comparable to that of parent antibodies. All N-terminal variable domains bound with a similar high affinity as the parent antibody. Some specific combinations of linker length in the heavy chain and light chain improved the binding affinity of the C-terminal domains comparable to the parent antibody. Specifically there is a statistically significant ($p=0.019$) improvement in affinity of the C-terminal domain with a long linker rather than a short linker in the light chain.

TABLE 6

Direct Bind ELISA Of 96 DVD-Ig Constructs With Various DLL4
Sequences, Orientations And Linker Length Combinations To DLL

| DVD-Ig ID | Sequence ID | Orientation | HC linker | LC linker | Other DVD-Ig Variable Domain | DVD-Ig DLL4 EC50 (nM) | Ref. Ab. ID | Ref. Ab. DLL4 EC50 (nM) |
|---|---|---|---|---|---|---|---|---|
| DVD043 | DLL4 (Seq. 1) | C-term. | Short | Short | VEGF (Seq. 1) | 0.67 | AB015 | 1.39 |
| DVD044 | DLL4 (Seq. 1) | N-term. | Short | Short | VEGF (Seq. 1) | 0.25 | AB015 | 1.39 |
| DVD469 | DLL4 (Seq. 1) | N-term. | Long | Long | VEGF (Seq. 1) | 2.78 | AB015 | 1.39 |
| DVD470 | DLL4 (Seq. 1) | C-term. | Long | Long | VEGF (Seq. 1) | 0.19 | AB015 | 1.39 |
| DVD475 | DLL4 (Seq. 1) | N-term. | Long | Short | VEGF (Seq. 1) | 0.23 | AB015 | 1.23 |
| DVD476 | DLL4 (Seq. 1) | C-term. | Long | Short | VEGF (Seq. 1) | 0.30 | AB015 | 1.23 |
| DVD481 | DLL4 (Seq. 1) | N-term. | Short | Long | VEGF (Seq. 1) | 3.30 | AB015 | 1.23 |
| DVD482 | DLL4 (Seq. 1) | C-term. | Short | Long | VEGF (Seq. 1) | 0.36 | AB015 | 1.23 |
| DVD441 | DLL4 (Seq. 4) | N-term. | Short | Short | VEGF (Seq. 1) | 0.04 | AB069 | 0.10 |
| DVD442 | DLL4 (Seq. 4) | C-term. | Short | Short | VEGF (Seq. 1) | 10.55 | AB069 | 0.10 |
| DVD447 | DLL4 (Seq. 4) | N-term. | Long | Long | VEGF (Seq. 1) | 0.12 | AB069 | 0.10 |
| DVD448 | DLL4 (Seq. 4) | C-term. | Long | Long | VEGF (Seq. 1) | 0.41 | AB069 | 0.10 |
| DVD453 | DLL4 (Seq. 4) | N-term. | Long | Short | VEGF (Seq. 1) | 0.09 | AB069 | 0.04 |
| DVD454 | DLL4 (Seq. 4) | C-term. | Long | Short | VEGF (Seq. 1) | 1.01 | AB069 | 0.04 |
| DVD459 | DLL4 (Seq. 4) | N-term. | Short | Long | VEGF (Seq. 1) | 0.26 | AB069 | 0.04 |
| DVD460 | DLL4 (Seq. 4) | C-term. | Short | Long | VEGF (Seq. 1) | 0.64 | AB069 | 0.04 |
| DVD511 | DLL4 (Seq. 2) | N-term. | Short | Short | VEGF (Seq. 1) | 0.10 | AB073 | 0.08 |
| DVD512 | DLL4 (Seq. 2) | C-term. | Short | Short | VEGF (Seq. 1) | 1.71 | AB073 | 0.08 |
| DVD517 | DLL4 (Seq. 2) | N-term. | Long | Long | VEGF (Seq. 1) | 0.10 | AB073 | 0.08 |
| DVD518 | DLL4 (Seq. 2) | C-term. | Long | Long | VEGF (Seq. 1) | 5.90 | AB073 | 0.08 |
| DVD523 | DLL4 (Seq. 2) | N-term. | Long | Short | VEGF (Seq. 1) | 0.09 | AB073 | 0.03 |
| DVD524 | DLL4 (Seq. 2) | C-term. | Long | Short | VEGF (Seq. 1) | 0.22 | AB073 | 0.03 |
| DVD529 | DLL4 (Seq. 2) | N-term. | Short | Long | VEGF (Seq. 1) | 0.10 | AB073 | 0.03 |
| DVD530 | DLL4 (Seq. 2) | C-term. | Short | Long | VEGF (Seq. 1) | 0.22 | AB073 | 0.03 |
| DVD487 | DLL4 (Seq. 3) | N-term. | Short | Short | VEGF (Seq. 1) | 0.14 | AB072 | 1.29 |
| DVD488 | DLL4 (Seq. 3) | C-term. | Short | Short | VEGF (Seq. 1) | 1.84 | AB072 | 1.29 |
| DVD493 | DLL4 (Seq. 3) | N-term. | Long | Long | VEGF (Seq. 1) | 0.06 | AB072 | 1.29 |
| DVD494 | DLL4 (Seq. 3) | C-term. | Long | Long | VEGF (Seq. 1) | 39.48 | AB072 | 1.29 |
| DVD499 | DLL4 (Seq. 3) | N-term. | Long | Short | VEGF (Seq. 1) | 0.09 | AB072 | 0.70 |
| DVD500 | DLL4 (Seq. 3) | C-term. | Long | Short | VEGF (Seq. 1) | 0.57 | AB072 | 0.70 |
| DVD505 | DLL4 (Seq. 3) | N-term. | Short | Long | VEGF (Seq. 1) | 0.09 | AB072 | 0.70 |
| DVD506 | DLL4 (Seq. 3) | C-term. | Short | Long | VEGF (Seq. 1) | 0.32 | AB072 | 0.70 |
| DVD467 | DLL4 (Seq. 1) | N-term. | Short | Short | VEGF (Seq. 2) | 0.54 | AB015 | 0.30 |
| DVD468 | DLL4 (Seq. 1) | C-term. | Short | Short | VEGF (Seq. 2) | 2.28 | AB015 | 0.30 |
| DVD473 | DLL4 (Seq. 1) | N-term. | Long | Long | VEGF (Seq. 2) | 1.80 | AB015 | 0.30 |
| DVD474 | DLL4 (Seq. 1) | C-term. | Long | Long | VEGF (Seq. 2) | 0.57 | AB015 | 0.30 |
| DVD479 | DLL4 (Seq. 1) | N-term. | Long | Short | VEGF (Seq. 2) | 1.69 | AB015 | 0.28 |
| DVD480 | DLL4 (Seq. 1) | C-term. | Long | Short | VEGF (Seq. 2) | 0.60 | AB015 | 0.28 |
| DVD485 | DLL4 (Seq. 1) | N-term. | Short | Long | VEGF (Seq. 2) | 1.41 | AB015 | 0.28 |
| DVD486 | DLL4 (Seq. 1) | C-term. | Short | Long | VEGF (Seq. 2) | 0.59 | AB015 | 0.28 |
| DVD445 | DLL4 (Seq. 4) | N-term. | Short | Short | VEGF (Seq. 2) | 0.17 | AB069 | 0.20 |
| DVD446 | DLL4 (Seq. 4) | C-term. | Short | Short | VEGF (Seq. 2) | 13.92 | AB069 | 0.20 |
| DVD451 | DLL4 (Seq. 4) | N-term. | Long | Long | VEGF (Seq. 2) | 0.40 | AB069 | 0.20 |
| DVD452 | DLL4 (Seq. 4) | C-term. | Long | Long | VEGF (Seq. 2) | 0.34 | AB069 | 0.20 |
| DVD457 | DLL4 (Seq. 4) | N-term. | Long | Short | VEGF (Seq. 2) | 0.13 | AB069 | 0.21 |
| DVD458 | DLL4 (Seq. 4) | C-term. | Long | Short | VEGF (Seq. 2) | 1.54 | AB069 | 0.21 |
| DVD463 | DLL4 (Seq. 4) | N-term. | Short | Long | VEGF (Seq. 2) | 0.50 | AB069 | 0.21 |
| DVD464 | DLL4 (Seq. 4) | C-term. | Short | Long | VEGF (Seq. 2) | 0.80 | AB069 | 0.21 |
| DVD515 | DLL4 (Seq. 2) | N-term. | Short | Short | VEGF (Seq. 2) | 0.20 | AB073 | 0.11 |
| DVD516 | DLL4 (Seq. 2) | C-term. | Short | Short | VEGF (Seq. 2) | 4.33 | AB073 | 0.11 |
| DVD521 | DLL4 (Seq. 2) | N-term. | Long | Long | VEGF (Seq. 2) | 0.26 | AB073 | 0.11 |
| DVD522 | DLL4 (Seq. 2) | C-term. | Long | Long | VEGF (Seq. 2) | 0.48 | AB073 | 0.11 |
| DVD527 | DLL4 (Seq. 2) | N-term. | Long | Short | VEGF (Seq. 2) | 0.20 | AB073 | 0.11 |
| DVD528 | DLL4 (Seq. 2) | C-term. | Long | Short | VEGF (Seq. 2) | 0.81 | AB073 | 0.11 |
| DVD533 | DLL4 (Seq. 2) | N-term. | Short | Long | VEGF (Seq. 2) | 0.25 | AB073 | 0.11 |
| DVD534 | DLL4 (Seq. 2) | C-term. | Short | Long | VEGF (Seq. 2) | 0.47 | AB073 | 0.11 |
| DVD491 | DLL4 (Seq. 3) | N-term. | Short | Short | VEGF (Seq. 2) | 0.39 | AB072 | 1.99 |
| DVD492 | DLL4 (Seq. 3) | C-term. | Short | Short | VEGF (Seq. 2) | 1.77 | AB072 | 1.99 |
| DVD497 | DLL4 (Seq. 3) | N-term. | Long | Long | VEGF (Seq. 2) | 0.53 | AB072 | 1.99 |
| DVD498 | DLL4 (Seq. 3) | C-term. | Long | Long | VEGF (Seq. 2) | 0.45 | AB072 | 1.99 |
| DVD503 | DLL4 (Seq. 3) | N-term. | Long | Short | VEGF (Seq. 2) | 0.33 | AB072 | 1.85 |
| DVD504 | DLL4 (Seq. 3) | C-term. | Long | Short | VEGF (Seq. 2) | 0.53 | AB072 | 1.85 |
| DVD509 | DLL4 (Seq. 3) | N-term. | Short | Long | VEGF (Seq. 2) | 0.21 | AB072 | 1.85 |
| DVD510 | DLL4 (Seq. 3) | C-term. | Short | Long | VEGF (Seq. 2) | 0.42 | AB072 | 1.85 |
| DVD465 | DLL4 (Seq. 1) | N-term. | Short | Short | VEGF (Seq. 3) | 0.57 | AB015 | 0.60 |
| DVD466 | DLL4 (Seq. 1) | C-term. | Short | Short | VEGF (Seq. 3) | 19.84 | AB015 | 0.60 |

TABLE 6-continued

Direct Bind ELISA Of 96 DVD-Ig Constructs With Various DLL4 Sequences, Orientations And Linker Length Combinations To DLL

| DVD-Ig ID | Sequence ID | Orientation | HC linker | LC linker | Other DVD-Ig Variable Domain | DVD-Ig DLL4 EC50 (nM) | Ref. Ab. ID | Ref. Ab. DLL4 EC50 (nM) |
|---|---|---|---|---|---|---|---|---|
| DVD471 | DLL4 (Seq. 1) | N-term. | Long | Long | VEGF (Seq. 3) | 0.89 | AB015 | 0.60 |
| DVD472 | DLL4 (Seq. 1) | C-term. | Long | Long | VEGF (Seq. 3) | 2.78 | AB015 | 0.60 |
| DVD477 | DLL4 (Seq. 1) | N-term. | Long | Short | VEGF (Seq. 3) | 0.69 | AB015 | 0.58 |
| DVD478 | DLL4 (Seq. 1) | C-term. | Long | Short | VEGF (Seq. 3) | 2.53 | AB015 | 0.58 |
| DVD483 | DLL4 (Seq. 1) | N-term. | Short | Long | VEGF (Seq. 3) | 0.63 | AB015 | 0.58 |
| DVD484 | DLL4 (Seq. 1) | C-term. | Short | Long | VEGF (Seq. 3) | 1.75 | AB015 | 0.58 |
| DVD443 | DLL4 (Seq. 4) | N-term. | Short | Short | VEGF (Seq. 3) | 0.20 | AB069 | 0.23 |
| DVD444 | DLL4 (Seq. 4) | C-term. | Short | Short | VEGF (Seq. 3) | 30.54 | AB069 | 0.23 |
| DVD449 | DLL4 (Seq. 4) | N-term. | Long | Long | VEGF (Seq. 3) | 0.36 | AB069 | 0.23 |
| DVD450 | DLL4 (Seq. 4) | C-term. | Long | Long | VEGF (Seq. 3) | 1.99 | AB069 | 0.23 |
| DVD455 | DLL4 (Seq. 4) | N-term. | Long | Short | VEGF (Seq. 3) | 0.24 | AB069 | 0.24 |
| DVD456 | DLL4 (Seq. 4) | C-term. | Long | Short | VEGF (Seq. 3) | 2.48 | AB069 | 0.24 |
| DVD461 | DLL4 (Seq. 4) | N-term. | Short | Long | VEGF (Seq. 3) | 0.52 | AB069 | 0.24 |
| DVD462 | DLL4 (Seq. 4) | C-term. | Short | Long | VEGF (Seq. 3) | 7.99 | AB069 | 0.24 |
| DVD513 | DLL4 (Seq. 2) | N-term. | Short | Short | VEGF (Seq. 3) | 0.66 | AB073 | 0.22 |
| DVD514 | DLL4 (Seq. 2) | C-term. | Short | Short | VEGF (Seq. 3) | 21.05 | AB073 | 0.22 |
| DVD519 | DLL4 (Seq. 2) | N-term. | Long | Long | VEGF (Seq. 3) | 1.53 | AB073 | 0.22 |
| DVD520 | DLL4 (Seq. 2) | C-term. | Long | Long | VEGF (Seq. 3) | 17.34 | AB073 | 0.22 |
| DVD525 | DLL4 (Seq. 2) | N-term. | Long | Short | VEGF (Seq. 3) | 1.00 | AB073 | 0.21 |
| DVD526 | DLL4 (Seq. 2) | C-term. | Long | Short | VEGF (Seq. 3) | 1.57 | AB073 | 0.21 |
| DVD531 | DLL4 (Seq. 2) | N-term. | Short | Long | VEGF (Seq. 3) | 0.57 | AB073 | 0.21 |
| DVD532 | DLL4 (Seq. 2) | C-term. | Short | Long | VEGF (Seq. 3) | 1.43 | AB073 | 0.21 |
| DVD489 | DLL4 (Seq. 3) | N-term. | Short | Short | VEGF (Seq. 3) | 0.62 | AB072 | 63.43 |
| DVD490 | DLL4 (Seq. 3) | C-term. | Short | Short | VEGF (Seq. 3) | 9.27 | AB072 | 63.43 |
| DVD495 | DLL4 (Seq. 3) | N-term. | Long | Long | VEGF (Seq. 3) | 0.33 | AB072 | 63.43 |
| DVD496 | DLL4 (Seq. 3) | C-term. | Long | Long | VEGF (Seq. 3) | 5.59 | AB072 | 63.43 |
| DVD501 | DLL4 (Seq. 3) | N-term. | Long | Short | VEGF (Seq. 3) | 0.18 | AB072 | 63.24 |
| DVD502 | DLL4 (Seq. 3) | C-term. | Long | Short | VEGF (Seq. 3) | 3.17 | AB072 | 63.24 |
| DVD507 | DLL4 (Seq. 3) | N-term. | Short | Long | VEGF (Seq. 3) | 0.71 | AB072 | 63.24 |
| DVD508 | DLL4 (Seq. 3) | C-term. | Short | Long | VEGF (Seq. 3) | 0.61 | AB072 | 63.24 |

Binding of all DVD-Ig constructs to DLL4 was maintained and comparable to that of parent antibodies. All N-terminal variable domains bound with a similar high affinity as the parent antibody. Some specific combinations of linker length in the heavy chain and light chain improved the binding affinity of the C-terminal domains comparable to the parent antibody. Specifically there is a trend for improvement in the affinity of the C-terminal domain with a long linker in the light chain and/or heavy chain rather than a short linker in both the light and heavy chain.

Example 1.1.1.B

Capture ELISA-VEGF

ELISA plates (Nunc, MaxiSorp, Rochester, N.Y.) were incubated overnight at 4° C. with anti-human Fc antibody (5 µg/ml in PBS, Jackson Immunoresearch, West Grove, Pa.). Plates were washed three times in washing buffer (PBS containing 0.05% Tween 20), and blocked for 1 hour at 25° C. in blocking buffer (PBS containing 1% BSA). Wells were washed three times, and serial dilutions of each antibody or DVD-Ig in PBS containing 0.1% BSA were added to the wells and incubated at 25° C. for 1 hour. The wells were washed three times, and biotinylated VEGF (2 nM) was added to the plates and incubated for 1 hour at 25° C. The wells were three times, and then incubated for 1 hour at 25° C. with streptavidin-HRP (KPL #474-3000, Gaithersburg, Md.). The wells were washed three times, and 100 µl of ULTRA-TMB ELISA (Pierce, Rockford, Ill.) were added per well. Following color development the reaction was stopped with 1N HCL and absorbance at 450 nM was measured. VEGF capture ELISA data is shown in Table 7.

Example 1.1.1.C

IgG-Fc Capture ELISA-RON 96-well Nunc-Immuno plates were coated with 2 µg/mL goat-anti-human IgG Fc specific antibody (Jackson Immunoresearch #109-055-098, West Grove, Pa., 50 µL/well) in PBS (Gibco #10010-023 from Invitrogen, Grand Island, N.Y.), and incubated overnight at 4° C. Plates were washed three times with washing buffer (PBS, 0.05% Tween 20) and subsequently blocked with 100 uL/well of blocking buffer (PBS, 2% BSA) for one hour at room temperature. Plates were washed three times and incubated with 50 µL/well of a 1 µg/mL solution of the appropriate antibody or DVD-Ig for one hour at room temperature. After the one hour incubation, the plates were washed three times and incubated with 50 µL/well of his-tagged, recombinant RON protein (R&D Systems #1947-MS, Minneapolis, Minn., 1000 nM to 0 nM final dose range) for one hour at room temperature. Plates were washed three times, and 50 µL/well of a rabbit-anti-His tag-HRP antibody (Abeam ab1187, Cambridge, Mass., diluted at 1:10,000 in 2% BSA/PBS solution) was added and plates were incubated at room temperature for one hour. After the final wash, 50 µl/well of TMB substrate (Pierce #34028, Rockford, Ill.) was added, and the reaction was terminated after five minutes using 50 µl/well of 2N H2SO4. The absorbance was read at 450 nm (Spectra Max Plus plate reader, Molecular Devices, Sunnyvale, Calif.). EC50s were calculated in GraphPad Prism 4.03. RON capture ELISA data is shown in Table 7.

Example 1.1.1.D

Capture ELISA-IGF1,2

96-well Nunc-Immuno plates were coated with 5 µg/ml antibody against human IgG (Fcγ fragment specific, Jackson ImmunoResearch, West Grove, Pa., #109-005-098, 100 µl/well) in D-PBS (Gibco #14190, San Diego, Calif.) and incubated overnight at 4° C. ELISA plates were washed three times in wash buffer (PBS, 0.05% Tween 20) and then blocked with 200 µl/well blocking buffer (D-PBS, 1% BSA) for 1 hour at 25° C. Plates were then washed and incubated with 100 µl/well antibodies or DVD-Igs (0.01 µg/mL-100 µg/mL in blocking buffer) for 1 hour at 37° C. Plates were then washed three times and incubated with biotin-labeled human IGF1 or IGF2 (0.02 nM-100 nM dose range in blocking buffer, 100 µl/well) for 1 hour at 37° C. Plates were washed three times and incubated with streptavidin conjugated with HRP (KPL #474-3000, Gaithersburg, Md., 1:10, 000 dilution in blocking buffer, 100 µl/well) for 1 hour at 25° C. After the final wash, plates were incubated with 100 µl/well ELISA substrate (1-Step Ultra TMB-ELISA, Pierce #340280, Rockford, Ill.). The reaction was stopped after 5 minutes at 25° C. with 100 µl/well 2N H2SO4 and the absorbance was read at 450 nm. IGF1,2 capture ELISA data is shown in Table 7.

Example 1.1.1.E

Capture ELISA DLL4

96-well Nunc-Immuno plates (#439454, Rochester, N.Y.) were coated with 5 µg/ml antibody against human IgG (Fc fragment specific, Jackson ImmunoResearch, West Grove, Pa. #109-005-098, 100 µl/well) in D-PBS (Gibco #14190, Grand Island, N.Y.) and incubated overnight at 4° C. ELISA plates were washed three times with wash buffer (PBS, 0.05% Tween 20) and then blocked with 200 µl/well blocking buffer (D-PBS, 1% BSA, 1 mM CaCl$_2$, 0.05% Tween 20) for 1 hour at 25° C. Plates were washed three times and incubated with 100 µl/well DLL4 antibodies (0.0001-100 nM, 10-fold serial dilution in blocking buffer) for 1 hour at 25° C., and then washed again three times. Plates containing captured DLL4 Ab were incubated with biotin-labeled human DLL4 extracellular domain (10 nM in blocking buffer, 100 µl/well) for 1 hour at 25° C., washed three times, and incubated with streptavidin conjugated with HRP (KPL #474-3000C, washed three times, and incubated with streptavidin conjugated with HRP (KPL #474-3000, Gaithersburg, Md., 1:10, 000 dilution in blocking buffer, 100 µl/well) for 1 hour at 25° C. After the final wash, plates were incubated with 100 µl/well ELISA substrate (1-Step Ultra TMB-ELISA, Pierce #340280, Rockford, Ill.). The reaction was stopped after 2 minutes at 25° C. with 100 µl/well 2N H2SO4 and the absorbance was read at 450 nm. DLL4 capture ELISA data is shown in Table 7.

Example 1.1.1.F

Capture ELISA ErbB3 or EGFR 96-well ELISA plates were coated with goat anti-human IgG Fc (Jackson Immunoresearch, Pa.) at a concentration of 33 nM, and incubated overnight at 4° C. The plates were washed with PBS containing 0.05% Tween 20 three times and blocked with 200 µl/well of 1% BSA/PBS for 1 hour at room temperature. Fifty µl of 5 nM DVD-Ig or antibody were added to each well and incubated for 1 hour at room temperature. The plates were washed, and then incubated with 50 µl/well of biotinylated ErbB3 or biotinylated EGFR at various concentrations for 1 hour at room temperature. The plates were washed again and then incubated with 50 µl/well of streptavidin-conjugated HRP (KPL #474-3000, Protein Research Products, Md.) and incubated for 1 hour at room temperature. The wells were washed three times, and 100 µl of ULTRA-TMB ELISA (Pierce, Rockford, Ill.) were added per well. Following color development, the reaction was stopped with 1N HCL and absorbance at 450 nM was measured.

Table 7 contains the affinity, expressed as EC50 in nM, of parent antibodies and DVD-Ig constructs in the VEGF, RON, EGFR, IGFR, IGF-1,2, HER-2, DLL4, and ErbB3.

TABLE 7

VEGF, RON, EGFR, ErbB3, IGFR, IGF-1, 2, DLL4 and HER-2 Antigen Capture ELISA of Parent Antibodies and DVD-Ig Constructs

| Parent Antibody or DVD-Ig ID | N-terminal Variable Domain | C-terminal Variable Domain | N-terminal Ag binding in Capture ELISA (EC50, nM) | C-terminal Ag binding in Capture ELISA (EC50, nM) |
|---|---|---|---|---|
| AB004 | | HER-2 | 0.4 | |
| AB010 | | IGF1, 2 | 4.8, 10 | |
| DVD029 | HER-2 | IGF1, 2 | | 229, 206 |
| DVD030 | IGF1, 2 | HER-2 | 1.8, 5.5 | 10.7 |
| AB033 | | EGFR | 0.3 | |
| AB011 | | IGF1R | 0.3 | |
| DVD021 | EGFR | IGF1R | 0.3 | 135 |
| DVD022 | IGF1R | EGFR | 0.3 | 0.7 |
| AB005 | | RON | 1.6 | |
| DVD024 | RON | EGFR | 1.96 | |
| DVD023 | EGFR | RON | | >100 |
| AB004 | | HER-2 | 0.2 | |
| AB011 | | IGF1R | 0.3 | |
| DVD031 | HER-2 | IGF1R | 0.3 | 171 |
| DVD032 | IGF1R | HER-2 | 0.2 | 11 |
| AB005 | | RON | 0.7 | |
| AB012 | | HGF | | |
| DVD033 | RON | HGF | 2.5 | |
| DVD034 | HGF | RON | | |
| AB014 | | VEGF | 0.24 | |
| DVD035 | VEGF | EGFR | 0.24 | |
| AB014 | | VEGF | 0.24 | |
| DVD038 | HER-2 | VEGF | | 2.00 |
| AB014 | | VEGF | 0.9 | |
| AB010 | | IGF1, 2 | 4.8, 18.1 | |
| DVD041 | VEGF | IGF1, 2 | 0.7 | 381, 7335 |
| DVD042 | IGF1, 2 | VEGF | 2.5, 17.6 | 42.3 |
| AB015 | | DLL-4 | 0.03 | |
| AB014 | | VEGF | 0.24 | |
| DVD044 | DLL4 | VEGF | 0.06 | 4.20 |
| DVD043 | VEGF | DLL4 | 0.20 | 0.50 |
| AB014 | | VEGF | 0.24 | |
| AB012 | | HGF | | |
| DVD045 | VEGF | HGF | 0.29 | >100 |
| AB005 | | RON | 1.3 | |
| AB014 | | VEGF | 0.24 | |
| DVD048 | RON | VEGF | 2.7 | 3.60 |
| DVD047 | VEGF | RON | 0.36 | >100 |
| AB014 | | VEGF | 0.24 | |
| DVD049 | VEGF | NRP1 | 4.80 | |
| DVD050 | NRP1 | VEGF | | 2.30 |
| AB014 | | VEGF | 0.53 | |
| DVD260 | P1GF | VEGF | | 1.70 |
| AB062 | | ErbB3 | 0.26 | |
| DVD299 | ErbB3 | EGFR | 0.32 | >10.0 |
| AB063 | | ErbB3 | 0.67 | |
| AB033 | | EGFR | | |
| DVD305 | ErbB3 | EGFR | 1.16 | |
| DVD306 | EGFR | ErbB3 | | >10.0 |

Binding of all DVD-Ig constructs to soluble antigen was maintained and comparable to parent antibodies. All N-terminal variable domains bound with a similar high affinity as to the parent antibody as well as the C-terminal variable domains of DVD022, DVD038, DVD043, DVD048, DVD50 and DVD260.

Example 1.1.1.G

Affinity Determination Using BIACORE Technology

TABLE 8

Reagent Used in Biacore Analyses

| Assay | Antigen | Vendor Designation | Vendor | Catalog # |
|---|---|---|---|---|
| DLL4 | DLL4 | DLL ECD His tag | R&D | 1506-D4-050 |
| EGFR | EGFR | EGFR ECD | R&D | 1095-ER |
| HER-2 | HER-2/FC | ErbB2/FC chimera-His tag | R&D | 1129-ER-050 |
| HGF | HGF | HGF | R&D | 294-HG-025 |
| IGF1 | IGF1 | IGF-I | R&D | 291-G1-050 |
| IGF2 | IGF2 | IGF-2 | R&D | 292-G2-050 |
| IGF1R | IGF1R | IGF1R ECD | R&D | 391-GR-050 |
| NRP1 | NRP1 | Neuropilin-1 Npn-1-His tag | R&D | 3870-N1-025 |
| PlGF | PlGF | Placental GF | R&D | 264-PG-050 |
| RON | RON | MSP Receptor ECD-His tag | R&D | 1947-MS-050 |
| VEGF | VEGF | VEGF | R&D | 293-VE-010 |
| ErbB3 | ErbB3 | ErbB3/FC Chimera-His tag | R&D | 348-RB |

ECD = Extracellular Domain
/FC = antigen/IgG FC domain fusion protein

BIACORE Methods:

The BIACORE assay (Biacore, Inc, Piscataway, N.J.) determines the affinity of antibodies or DVD-Ig with kinetic measurements of on-rate and off-rate constants. Binding of antibodies or DVD-Ig to a target antigen (for example, a purified recombinant target antigen) is determined by surface plasmon resonance-based measurements with a Biacore® 1000 or 3000 instrument (Biacore® AB, Uppsala, Sweden) using running HBS-EP (10 mM HEPES [pH 7.4], 150 mM NaCl, 3 mM EDTA, and 0.005% surfactant P20) at 25° C. All chemicals are obtained from Biacore® AB (Uppsala, Sweden) or otherwise from a different source as described in the text. For example, approximately 5000 RU of goat anti-mouse IgG, (Fcγ), fragment specific polyclonal antibody (Pierce Biotechnology Inc, Rockford, Ill.) diluted in 10 mM sodium acetate (pH 4.5) is directly immobilized across a CM5 research grade biosensor chip using a standard amine coupling kit according to manufacturer's instructions and procedures at 25 µg/ml. Unreacted moieties on the biosensor surface are blocked with ethanolamine. Modified carboxymethyl dextran surface in flowcell 2 and 4 is used as a reaction surface. Unmodified carboxymethyl dextran without goat anti-mouse IgG in flow cell 1 and 3 is used as the reference surface. For kinetic analysis, rate equations derived from the 1:1 Langmuir binding model are fitted simultaneously to association and dissociation phases of all eight injections (using global fit analysis) with the use of Biaevaluation 4.0.1 software. Purified antibodies or DVD-Ig are diluted in HEPES-buffered saline for capture across goat anti-mouse IgG specific reaction surfaces. Antibodies or DVD-Ig to be captured as a ligand (25 µg/ml) are injected over reaction matrices at a flow rate of 5 µl/min. The association and dissociation rate constants, $k_{on}$ ($M^{-1}s^{-1}$) and $k_{off}$ ($s^{-1}$) are determined under a continuous flow rate of 25 µl/min. Rate constants are derived by making kinetic binding measurements at different antigen concentrations ranging from 10-200 nM. The equilibrium dissociation constant (M) of the reaction between antibodies or DVD-Igs and the target antigen is then calculated from the kinetic rate constants by the following formula: $K_D = k_{off}/k_{on}$. Binding is recorded as a function of time and kinetic rate constants are calculated. In this assay, on-rates as fast as $10^6$ $M^{-1}s^{-1}$ and off-rates as slow as $10^{-6}$ $s^{-1}$ can be measured.

TABLE 9

BIACORE Analysis of Parental Antibodies and DVD Constructs

| Parent Antibody | N-Terminal | C-Terminal | $k_{on}$ (M-1s-1) | $k_{off}$ (s-1) | $K_D$ (M) |
|---|---|---|---|---|---|
| AB011 | | IGF1R | 7.32E+04 | 6.21E-05 | 8.48E-10 |
| DVD021 | EGFR | | 1.22E+06 | 1.80E-03 | 1.47E-9 |
| DVD021 | | IGF1R | | | |
| DVD022 | IGF1R | | 1.06E+05 | 8.25E-05 | 7.78E-10 |
| DVD022 | | EGFR | 8.03E+04 | 2.26E-04 | 2.81E-9 |
| AB004 | | HER-2 | 3.22E+05 | 1.28E-05 | 3.97E-11 |
| AB011 | | IGF1R | 7.32E+04 | 6.21E-05 | 8.48E-10 |
| DVD031 | HER-2 | | 3.30E+05 | 7.02E-06 | 2.12E-11 |
| DVD031 | | IGF1R | | | |
| DVD032 | IGF1R | | 5.10E+04 | 4.23E-05 | 8.29E-10 |
| DVD032 | | HER-2 | 1.84E+04 | 9.31E-06 | 5.05E-10 |
| AB004 | | HER-2 | 3.22E+05 | 1.28E-05 | 3.97E-11 |
| AB010 | | IGF1 | 3.17E+06 | 1.23E-03 | 3.88E-10 |
| AB010 | | IGF2 | 6.47E+06 | 2.74E-06 | 4.23E-13 |
| DVD029 | HER-2 | | 2.42E+05 | 9.64E-06 | 3.98E-11 |
| DVD029 | | IGF1 | 6.65E+04 | 4.23E-04 | 6.36E-9 |
| DVD029 | | IGF2 | 1.04E+05 | 3.15E-05 | 3.02E-10 |
| DVD030 | IGF1 | | 3.96E+06 | 1.16E-03 | 2.92E-10 |
| DVD030 | IGF2 | | 8.46E+06 | 1.98E-05 | 2.34E-12 |
| DVD030 | | HER-2 | 1.54E+05 | 7.36E-04 | 4.77E-9 |
| AB033 | | EGFR | 7.93E+04 | 1.39E-03 | 1.75E-8 |
| AB004 | | HER-2 | 3.22E+05 | 1.28E-05 | 3.97E-11 |
| DVD015 | EGFR | | 1.79E+06 | 1.96E-03 | 1.09E-9 |
| DVD015 | | HER-2 | | | |
| DVD016 | HER-2 | | 2.44E+05 | 4.36E-06 | 1.78E-11 |
| DVD016 | | EGFR | 2.36E+04 | 4.53E-04 | 1.92E-8 |
| AB014 | | VEGF | 1.47E+05 | 3.03E-05 | 2.07E-10 |

TABLE 9-continued

BIACORE Analysis of Parental Antibodies and DVD Constructs

| Parent Antibody or DVD-Ig ID | N-Terminal Variable Domain (VD) | C-Terminal Variable Domain (VD) | $k_{on}$ (M−1s−1) | $k_{off}$ (s−1) | $K_D$ (M) |
|---|---|---|---|---|---|
| AB010 | | IGF1 | | | |
| AB010 | | IGF2 | 3.35E+06 | <1.00E−06 | <2.99E−13 |
| DVD041 | VEGF | | 5.26E+05 | 2.39E−06 | 4.55E−12 |
| DVD041 | | IGF1 | | | |
| DVD041 | | IGF2 | 8.09E+04 | <1.00E−06 | <1.24E−11 |
| DVD042 | IGF1 | | | | |
| DVD042 | IGF2 | | 5.20E+06 | 5.18E−06 | 9.98E−13 |
| DVD042 | | VEGF | 3.45E+04 | 1.46E−05 | 4.21E−10 |
| AB005 | | RON | 3.66E+04 | 7.39E−04 | 2.02E−8 |
| AB033 | | EGFR | 7.93E+04 | 1.39E−03 | 1.75E−8 |
| DVD024 | RON | | 4.56E+04 | 8.52E−04 | 1.86E−8 |
| DVD024 | | EGFR | | | |
| DVD023 | EGFR | | 2.08E+06 | 2.22E−03 | 1.06E−9 |
| DVD023 | | RON | | | |
| AB005 | | RON | 3.66E+04 | 7.39E−04 | 2.02E−8 |
| AB012 | | HGF | >1.00E+7 | 2.84E−04 | <2.84E−11 |
| DVD033 | RON | | 1.56E+05 | 1.18E−03 | 7.60E−09 |
| DVD033 | | HGF | 2.97E+05 | 9.20E−05 | 3.10E−10 |
| DVD034 | HGF | | 3.05E+06 | 6.55E−05 | 2.15E−11 |
| DVD034 | | RON | | | |
| AB005 | | RON | 3.66E+04 | 7.39E−04 | 2.01E−8 |
| AB014 | | VEGF | 3.06E+05 | 3.99E−06 | 1.30E−11 |
| DVD048 | RON | | | | |

| Parent Antibody or DVD-Ig ID | N-Terminal Variable Domain (VD) | C-Terminal Variable Domain (VD) | $k_{on}$ (M−1s−1) | $k_{off}$ (s−1) | $K_D$ (M) |
|---|---|---|---|---|---|
| DVD048 | | VEGF | 3.85E+04 | 4.50E−05 | 1.17E−9 |
| DVD047 | VEGF | | 3.46E+05 | 2.79E−05 | 8.06E−11 |
| DVD047 | | RON | | | |
| AB015 | | DLL-4 | 4.00E+05 | 1.66E−04 | 4.14E−10 |
| AB014 | | VEGF | 1.47E+05 | 3.03E−05 | 2.07E−10 |
| DVD044 | DLL4 | | 5.90E+05 | 2.05E−04 | 3.47E−10 |
| DVD044 | | VEGF | 3.67E+04 | 1.13E−05 | 3.08E−10 |
| DVD043 | VEGF | | 4.94E+05 | 8.26E−06 | 1.67E−11 |
| DVD043 | | DLL4 | 9.37E+04 | 2.17E−04 | 2.32E−09 |
| AB015 | | DLL-4 | | | |
| AB047 | | P1GF | 3.80E+06 | 1.08E−04 | 2.84E−11 |
| DVD257 | DLL4 | | 8.35E+05 | 1.96E−04 | 2.34E−10 |
| DVD257 | | P1GF | 3.02E+05 | 1.11E−04 | 3.67E−10 |
| DVD258 | P1GF | | >1.00E+07 | 2.54E−03 | <2.54E−10 |
| DVD258 | | DLL4 | | | |
| AB014 | | VEGF | 1.47E+05 | 3.03E−05 | 2.07E−10 |
| AB033 | | EGFR | 8.85E+05 | 1.23E−03 | 1.39E−09 |
| DVD035 | VEGF | | 2.25E+05 | 1.73E−05 | 8.23E−11 |
| DVD035 | | EGFR | | | |
| DVD036 | EGFR | | 1.21E+06 | 1.57E−03 | 1.30E−09 |
| DVD036 | | VEGF | 4.80E+04 | 3.19E−04 | 6.65E−09 |
| AB014 | | VEGF | 3.07E+05 | 3.39E−05 | 1.06E−11 |
| AB004 | | HER-2 | 3.02E+05 | 1.03E−05 | 3.40E−11 |
| DVD037 | VEGF | | 4.45E+05 | <1.00E−06 | <2.25E−12 |
| DVD037 | | HER-2 | 7.61E+03 | 2.83E−06 | 3.72E−10 |
| DVD038 | HER-2 | | 1.95E+05 | 4.81E−06 | 2.47E−11 |
| DVD038 | | VEGF | 3.67E+04 | <1.00E−06 | <2.27E−11 |
| AB014 | | VEGF | 1.47E+05 | 3.03E−05 | 2.07E−10 |
| AB012 | | HGF | >1.00E+7 | 2.84E−04 | <2.84E−11 |
| DVD045 | VEGF | | 2.01E+05 | 3.05E−06 | 1.52E−11 |
| DVD045 | | HGF | 1.84E+05 | 1.66E−04 | 9.01E−10 |
| DVD046 | HGF | | >1.00E+7 | 2.36E−04 | <2.36E−11 |
| DVD046 | | VEGF | | | |
| AB014 | | VEGF | 3.06E+05 | 3.99E−06 | 1.30E−11 |
| AB016 | | NRP1 | 1.47E+05 | 3.90E−04 | 2.67E−9 |
| DVD049 | VEGF | | | | |
| DVD049 | | NRP1 | 1.42E+05 | 1.81E−04 | 1.28E−9 |
| DVD050 | NRP1 | | 1.82E+05 | 2.61E−04 | 1.440E−9 |
| DVD050 | | VEGF | 1.82E+05 | 2.61E−04 | 1.440E−9 |
| AB014 | | VEGF | 3.07E+05 | 3.39E−05 | 1.06E−10 |
| AB047 | | P1GF | 3.80E+06 | 1.08E−04 | 2.85E−11 |
| DVD259 | VEGF | | 5.02E+05 | 2.06E−05 | 4.12E−11 |
| DVD259 | | P1GF | 2.99E+05 | 9.87E−05 | 3.30E−10 |
| DVD260 | P1GF | | 4.27E+06 | 5.14E−05 | 1.20E−11 |
| DVD260 | | VEGF | 4.99E+04 | 2.05E−05 | 4.11E−10 |
| AB033 | | EGFR | 8.85E+05 | 1.23E−03 | 1.39E−09 |
| AB012 | | HGF | >1.00E+7 | 2.84E−04 | <2.84E−11 |
| DVD025 | EGFR | | 7.31E+05 | 1.44E−03 | 1.98E−09 |
| DVD025 | | HGF | 3.05E+05 | 2.28E−04 | 7.46E−10 |

TABLE 9-continued

BIACORE Analysis of Parental Antibodies and DVD Constructs

| | | | | | |
|---|---|---|---|---|---|
| DVD026 | HGF | | 4.19E+06 | 6.67E−05 | 1.59E−11 |
| DVD026 | | EGFR | | | |
| AB062 | | ErbB3 | 8.66E+04 | 1.17E−04 | 1.360E−9 |
| AB033 | | EGFR | 7.93E+04 | 1.39E−03 | 1.75E−8 |
| DVD299 | ErbB3 | | 1.95E+05 | 1.60E−04 | 8.20E−10 |
| DVD299 | | EGFR | 3.26E+04 | 4.48E−04 | 1.37E−8 |
| DVD300 | EGFR | | 1.52E+06 | 1.69E−03 | 1.11E−9 |
| DVD300 | | ErbB3 | | | |
| AB063 | | ErbB3 | 1.17E+06 | 1.75E−04 | 1.50E−10 |
| AB033 | | EGFR | 7.93E+04 | 1.39E−03 | 1.75E−8 |
| DVD305 | ErbB3 | | 2.27E+06 | 1.37E−04 | 6.03E−11 |
| DVD305 | | EGFR | 3.99E+04 | 3.17E−04 | 7.940E−9 |
| DVD306 | EGFR | | 1.82E+06 | 1.86E−03 | 1.020E−9 |
| DVD306 | | ErbB3 | | | |

Binding of all DVD-Ig constructs characterized by Biacore technology was maintained and comparable to that of parent antibodies. All N-terminal variable domains bound with a similar high affinity as the parent antibody as well as the C-terminal variable domains of DVD-Ig constructs DVD022, DVD016, DVD042, DVD 044, DVD043, DVD038, DVD049, DVD260, DVD299, and DVD305.

Example 1.1.2

Assays Used to Determine the Functional Activity of Parent Antibodies and DVD-Ig

Example 1.1.2.A

Cytokine Bioassay

The ability of an anti-cytokine or an anti-growth factor parent antibody or DVD-Ig containing anti-cytokine or anti-growth factor sequences to inhibit or neutralize a target cytokine or growth factor bioactivity is analyzed by determining the inhibitory potential of the antibody or DVD-Ig. For example, the ability of an anti-IL-4 antibody to inhibit IL-4 mediated IgE production may be used. For example, human naive B cells are isolated from peripheral blood, respectively, buffy coats by Ficoll-paque density centrifugation, followed by magnetic separation with MACS beads (Miltenyi Biotec, Bergisch Gladbach, Germany) specific for human sIgD FITC labeled goat F(ab)2 antibodies followed by anti-FITC MACS beads. Magnetically sorted naive B cells are adjusted to 3×10$^5$ cells per ml in XV15 and plated out in 100 µl per well of 96-well plates in a 6×6 array in the center of the plate, surrounded by PBS filled wells during the 10 days of culture at 37° C. in the presence of 5% CO$_2$. One plate each is prepared per antibody to be tested, consisting of 3 wells each of un-induced and induced controls and quintuplicate repeats of antibody titrations starting at 7 µg/ml and running in 3-fold dilution down to 29 ng/ml final concentrations added in 50 µl four times concentrated pre-dilution. To induce IgE production, rhIL-4 at 20 ng/ml plus anti-CD40 monoclonal antibody (Novartis, Basel, Switzerland) at 0.5 µg/ml final concentrations in 50 µl each are added to each well, and IgE concentrations are determined at the end of the culture period by a standard sandwich ELISA method.

Example 1.1.2.B

Cytokine Release Assay

The ability of a parent antibody or DVD-Ig to cause cytokine release is analyzed. Peripheral blood is withdrawn from three healthy donors by venipuncture into heparized vacutainer tubes. Whole blood is diluted 1:5 with RPMI-1640 medium and placed in 24-well tissue culture plates at 0.5 mL per well. The anti-cytokine antibodies (e.g., anti-IL-4) are diluted into RPMI-1640 and placed in the plates at 0.5 mL/well to give final concentrations of 200, 100, 50, 10, and 1 µg/mL. The final dilution of whole blood in the culture plates is 1:10. LPS and PHA are added to separate wells at 2 µg/mL and 5 µg/mL final concentration as a positive control for cytokine release. Polyclonal human IgG is used as negative control antibody. The experiment is performed in duplicate. Plates are incubated at 37° C. at 5% CO$_2$. Twenty-four hours later the contents of the wells are transferred into test tubes and spun for 5 minutes at 1200 rpm. Cell-free supernatants are collected and frozen for cytokine assays. Cells left over on the plates and in the tubes are lysed with 0.5 mL of lysis solution, and placed at −20° C. and thawed. 0.5 mL of medium is added (to bring the volume to the same level as the cell-free supernatant samples) and the cell preparations are collected and frozen for cytokine assays. Cell-free supernatants and cell lysates are assayed for cytokine levels by ELISA, for example, for levels of IL-8, IL-6, IL-1β, IL-1RA, or TNF-α.

Example 1.1.2.C

Cytokine Cross-Reactivity Study

The ability of an anti-cytokine parent antibody or DVD-Ig directed to a cytokine(s) of interest to cross react with other cytokines is analyzed. Parent antibodies or DVD-Ig are immobilized on a Biacore biosensor matrix. An anti-human Fc mAb is covalently linked via free amine groups to the dextran matrix by first activating carboxyl groups on the matrix with 100 mM N-hydroxysuccinimide (NHS) and 400 mM N-Ethyl-N'-(3-dimethylaminopropyl)-carbodiimide hydrochloride (EDC). Approximately 50 µL of each antibody or DVD-Ig preparation at a concentration of 25 µg/mL, diluted in sodium acetate, pH 4.5, is injected across the activated biosensor and free amines on the protein are bound directly to the activated carboxyl groups. Typically, 5000 Resonance Units (RU's) are immobilized. Unreacted matrix EDC-esters are deactivated by an injection of 1 M ethanolamine. A second flow cell is prepared as a reference standard by immobilizing human IgG1/K using the standard amine coupling kit. SPR measurements are performed using the CM biosensor chip. All antigens to be analyzed on the biosensor surface are diluted in HBS-EP running buffer containing 0.01% P20.

To examine the cytokine binding specificity, excess cytokine of interest (100 nM, e.g., soluble recombinant human) is injected across the anti-cytokine parent antibody or DVD-Ig immobilized biosensor surface (5 minute contact time). Before injection of the cytokine of interest and immediately afterward, HBS-EP buffer alone flows through each flow cell. The net difference in the signals between the baseline and the point corresponding to approximately 30 seconds after completion of cytokine injection are taken to represent the final binding value. Again, the response is measured in Resonance Units. Biosensor matrices are regenerated using 10 mM HCl before injection of the next sample where a binding event is observed, otherwise running buffer was injected over the matrices. Human cytokines (e.g., IL-1α, IL-1β, IL-2, IL-3, IL-4, IL-5, IL-6, IL-7, IL-8, IL-9, IL-10, IL-11, IL-12, IL-13, IL-15, IL-16, IL-17, IL-18, IL-19, IL-20, IL-22, IL-23, IL-27, TNF-α, TNF-β, and IFN-γ, for example) are also simultaneously injected over the immobilized mouse IgG1/K reference surface to record any nonspecific binding background. By preparing a reference and reaction surface, Biacore can automatically subtract the reference surface data from the reaction surface data in order to eliminate the majority of the refractive index change and injection noise. Thus, it is possible to ascertain the true binding response attributed to an anti-cytokine antibody or DVD-Ig binding reaction.

When a cytokine of interest is injected across immobilized anti-cytokine antibody, significant binding is observed. 10 mM HCl regeneration completely removes all non-covalently associated proteins. Examination of the sensorgram shows that immobilized anti-cytokine antibody or DVD-Ig binding to soluble cytokine is strong and robust. After confirming the expected result with the cytokine of interest, the panel of remaining recombinant human cytokines is tested, for each antibody or DVD-Ig separately. The amount of anti-cytokine antibody or DVD-Ig bound or unbound cytokine for each injection cycle is recorded. The results from three independent experiments are used to determine the specificity profile of each antibody or DVD-Ig. Antibodies or DVD-Ig with the expected binding to the cytokine of interest and no binding to any other cytokine are selected.

Example 1.1.2.D

Tissue Cross Reactivity

Tissue cross reactivity studies are done in three stages, with the first stage including cryosections of 32 tissues, second stage including up to 38 tissues, and the $3^{rd}$ stage including additional tissues from 3 unrelated adults as described below. Studies are done typically at two dose levels.

Stage 1: Cryosections (about 5 μm) of human tissues (32 tissues (typically: Adrenal Gland, Gastrointestinal Tract, Prostate, Bladder, Heart, Skeletal Muscle, Blood Cells, Kidney, Skin, Bone Marrow, Liver, Spinal Cord, Breast, Lung, Spleen, Cerebellum, Lymph Node, Testes, Cerebral Cortex, Ovary, Thymus, Colon, Pancreas, Thyroid, Endothelium, Parathyroid, Ureter, Eye, Pituitary, Uterus, Fallopian Tube and Placenta) from one human donor obtained at autopsy or biopsy) are fixed and dried on object glass. The peroxidase staining of tissue sections is performed, using the avidin-biotin system.

Stage 2: Cryosections (about 5 μm) of human tissues 38 tissues (including adrenal, blood, blood vessel, bone marrow, cerebellum, cerebrum, cervix, esophagus, eye, heart, kidney, large intestine, liver, lung, lymph node, breast mammary gland, ovary, oviduct, pancreas, parathyroid, peripheral nerve, pituitary, placenta, prostate, salivary gland, skin, small intestine, spinal cord, spleen, stomach, striated muscle, testis, thymus, thyroid, tonsil, ureter, urinary bladder, and uterus) from 3 unrelated adults obtained at autopsy or biopsy) are fixed and dried on object glass. The peroxidase staining of tissue sections is performed, using the avidin-biotin system.

Stage 3: Cryosections (about 5 μm) of cynomolgus monkey tissues (38 tissues (including adrenal, blood, blood vessel, bone marrow, cerebellum, cerebrum, cervix, esophagus, eye, heart, kidney, large intestine, liver, lung, lymph node, breast mammary gland, ovary, oviduct, pancreas, parathyroid, peripheral nerve, pituitary, placenta, prostate, salivary gland, skin, small intestine, spinal cord, spleen, stomach, striated muscle, testis, thymus, thyroid, tonsil, ureter, urinary bladder, and uterus) from 3 unrelated adult monkeys obtained at autopsy or biopsy) are fixed and dried on object glass. The peroxidase staining of tissue sections is performed, using the avidin-biotin system.

The antibody or DVD-Ig is incubated with the secondary biotinylated anti-human IgG and developed into immune complex. The immune complex at the final concentrations of 2 and 10 μg/mL of antibody or DVD-Ig is added onto tissue sections on object glass and then the tissue sections are reacted for 30 minutes with a avidin-biotin-peroxidase kit. Subsequently, DAB (3,3'-diaminobenzidine), a substrate for the peroxidase reaction, is applied for 4 minutes for tissue staining. Antigen-Sepharose beads are used as positive control tissue sections. Target antigen and human serum blocking studies serve as additional controls. The immune complex at the final concentrations of 2 and 10 μg/mL of antibody or DVD-Ig is pre-incubated with target antigen (final concentration of 100 μg/ml) or human serum (final concentration 10%) for 30 minutes, and then added onto the tissue sections on object glass and then the tissue sections are reacted for 30 minutes with a avidin-biotin-peroxidase kit. Subsequently, DAB (3,3'-diaminobenzidine), a substrate for the peroxidase reaction, is applied for 4 minutes for tissue staining.

Any specific staining is judged to be either an expected (e.g., consistent with antigen expression) or unexpected reactivity based upon known expression of the target antigen in question. Any staining judged specific is scored for intensity and frequency. The tissue staining between stage 2 (human tissue) and stage 3 (cynomolgus monkey tissue) is either judged to be similar or different.

Example 1.1.2.E

Inhibition of HUVEC Proliferation/Survival by VEGF Parent Antibody and DVD-Ig Constructs Prior to plating for the assay, normal human umbilical vascular endothelial cells or HUVEC (passage 2-6) were maintained in EBM-2 (Lonza-Clonetics, Walkersville, Md.) supplemented with EGM-2 SingleQuots (Lonza-Clonetics, Walkersville, Md., #CC-4176). HUVEC cells were plated at 10,000 cells/well on collagen coated black 96-well plates in (100 μl) EMB-2 with 0.1% FBS in the absence of growth factors. The following day the media was replaced with 0.1% FBS in the absence of growth factors. The following day the media was replaced with 100 μl of EMB-2 (without growth factors or serum) and incubated for four hours prior to the addition of VEGF and antibodies/DVD-Igs. Anti-VEGF monoclonal antibodies or DVD-Igs (at final concentrations of 67 nM, 6.7 nM and 0.67 nM) were diluted in EMB-2 with 0.1% BSA and were pre-incubated with recombinant human $VEGF_{165}$ (50 ng/ml) for 1 hour at 25° C. in 504 Antibody/DVD-Ig and VEGF mixtures were then added to the cells (50 μl), and the plates were incubated at 37° C. in a humidified, 5% $CO_2$ atmosphere for 72 hours. Cell survival/proliferation was measured indirectly by assessing ATP levels using an ATPlite kit (Perkin Elmer, Waltham, Mass.) according to the manufacturer's instructions. Table 10 provides the data showing inhibition of HUVEC proliferation/survival.

TABLE 10

Inhibition Of HUVEC Proliferation/Survival By VEGF Parent Antibody And DVD-Ig Constructs

| Parent Antibody or DVD-Ig ID | N-terminal Variable Domain (VD) | C-terminal Variable Domain (VD) | N-terminal VD inhibition of HUVEC proliferation (% inhibition at 67, 6.7 and 0.67 nM Ab/DVD-Ig) | C-terminal VD inhibition of HUVEC proliferation (% inhibition at 67, 6.7 and 0.67 nM Ab/DVD-Ig) |
|---|---|---|---|---|
| AB014 | | VEGF | 67 nM = 98%, 6.7 nM = 91%, 0.67 nM = 12% | |
| DVD038 | HER-2 | VEGF | | 67 nM = 45%, 6.7 nM = −18%, 0.67 nM = −22% |
| AB014 | | VEGF | 67 nM = 98%, 6.7 nM = 91%, 0.67 nM = 12% | |
| DVD044 | DLL4 | VEGF | | 67 nM = 99%, 6.7 nM = 19%, 0.67 nM = 6% |
| DVD043 | VEGF | DLL4 | 67 nM = 89%, 6.7 nM = 51%, 0.67 nM = −22% | |
| AB014 | | VEGF | 67 nM = 97%, 6.7 nM = 91%, 0.67 nM = 62% | |
| DVD048 | RON | VEGF | | 67 nM = 91%, 6.7 nM = 88%, 0.67 nM = 62% |
| DVD047 | VEGF | RON | 67 nM = 65%, 6.7 nM = 31%, 0.67 nM = −5% | |
| AB014 | | VEGF | 67 nM = 97%, 6.7 nM = 91%, 0.67 nM = 62% | |
| DVD049 | VEGF | NRP1 | 67 nM = 108%, 6.7 nM = 86%, 0.67 nM = 43% | |
| DVD050 | NRP1 | VEGF | | 67 nM = 103%, 6.7 nM = 74%, 0.67 nM = 15% |
| AB014 | | VEGF | 67 nM = 98%, 6.7 nM = 91%, 0.67 nM = 12% | |
| DVD260 | P1GF | VEGF | | 67 nM = 51%, 6.7 nM = 7%, 0.67 nM = −16% |

All DVD-Igs containing VDs from AB014 inhibited HUVEC cell proliferation caused by VEGF. DVD044, DVD048, DVD040 DVD050 inhibited HUVEC cell proliferation by >90% at 67 nM concentration of DVD-Igs.

Example 1.1.2.F

Tumor Cell Growth Inhibitory Effect of IGF1,2 Monoclonal Antibodies or DVD-Igs In Vitro IGF1,2 monoclonal antibodies or DVD-Igs diluted in D-PBS-BSA (Dulbecco's phosphate buffered saline with 0.1% BSA) 20 μL were added to human tumor cells at final concentrations of 0.01 μg/mL-100 μg/mL in 200 μL. The plates were incubated at 37° C. in a humidified, 5% $CO_2$ atmosphere for three days. The number of live cells in each well was quantified using MTS reagents according to the manufacturer's instructions (Promega, Madison, Wis.) to determine the percent of tumor growth inhibition. Wells without antibody treatment were used as controls of 0% inhibition whereas wells without cells were considered to show 100% inhibition.

TABLE 11

H929, IGFR Line Proliferation Inhibition Assay With IGF1R and IGF1, 2 Parent Antibodies and DVD-Ig Constructs

| Parent Antibody or DVD-Ig ID | N-terminal Variable Domain (VD) | C-terminal Variable Domain (VD) | N-terminal VD Proliferation Inhibition Cellular Assay IC50 nM (H929, IGF1R line) | C-terminal VD Proliferation Inhibition Cellular Assay IC50 nM (H929, IGF1R line) |
|---|---|---|---|---|
| AB033 | | EGFR | | >67 (5% max) |
| AB004 | | HER-2 | | >67 (10% max) |
| DVD015 | EGFR | HER-2 | >50 (20% max) | |
| DVD016 | HER-2 | EGFR | | >50 (15% max) |
| AB033 | | EGFR | | >67 (5% max) |
| AB011 | | IGF1R | | 0.1 (65% max) |
| DVD021 | EGFR | IGF1R | | >50 (10% max) |
| DVD022 | IGF1R | EGFR | 0.05 (70% max) | |
| AB004 | | HER-2 | | >67 (10% max) |
| AB010 | | IGF1, 2 | | 1.6 (70% max) |
| DVD029 | HER-2 | IGF1, 2 | | 6.8 (40% max) |

TABLE 11-continued

H929, IGFR Line Proliferation Inhibition Assay With IGF1R and IGF1, 2 Parent Antibodies and DVD-Ig Constructs

| Parent Antibody or DVD-Ig ID | N-terminal Variable Domain (VD) | C-terminal Variable Domain (VD) | N-terminal VD Proliferation Inhibition Cellular Assay IC50 nM (H929, IGF1R line) | C-terminal VD Proliferation Inhibition Cellular Assay IC50 nM (H929, IGF1R line) |
|---|---|---|---|---|
| DVD030 | IGF1, 2 | HER-2 | 0.8 (70% max) | |
| AB004 | | HER-2 | | >67 (10%) |
| AB011 | | IGF1R | | 0.1 (65% max) |
| DVD031 | HER-2 | IGF1R | | >50 (10% max) |
| DVD032 | IGF1R | HER-2 | 0.1 (60% max) | |

All DVD-Igs containing VDs from AB033, AB004, AB011, or AB010 in either the N-terminal or C-terminal position showed inhibition in the A431 cell proliferation assay.

Example 1.1.2.G

Growth Inhibitory Effect of an EGFR Monoclonal Antibody or DVD-Igs In Vitro

EGFR monoclonal antibodies or DVD-Igs diluted in D-PBS-BSA (Dulbecco's phosphate buffered saline with 0.1% BSA) 20 μL were added to human tumor cells at final concentrations of 0.01 μg/mL-100 μg/mL in 180 uL. The plates were incubated at 37° C. in a humidified, 5% $CO_2$ atmosphere for 3 days. The number of live cells in each well was quantified using MTS reagents according to the manufacturer's instructions (Promega, Madison, Wis.) to determine the percent of tumor growth inhibition. Wells without antibody treatment were used as controls of 0% inhibition whereas wells without cells were considered to show 100% inhibition.

TABLE 12

A431, EGFR Cell Line Proliferation Inhibition Assay With EGFR Parent Antibodies And DVD-Ig Constructs

| Parent Antibody or DVD-Ig ID | N-terminal Variable Domain (VD) | C-terminal Variable Domain (VD) | N-terminal VD Proliferation Inhibition Cellular Assay IC50 nM (A431, EGFR line) | C-terminal VD Proliferation Inhibition Cellular Assay IC50 nM (A431 EGFR line) |
|---|---|---|---|---|
| AB033 | | EGFR | 1.0 (65% max) | |
| AB004 | | HER-2 | >67 (10% max) | |
| DVD015 | EGFR | HER-2 | 1.7 (65% max) | |
| DVD016 | HER-2 | EGFR | | 5.4 (80% max) |
| AB033 | | EGFR | 1.0 (65% max) | |
| AB011 | | IGF1R | >67 (5% max) | |
| DVD021 | EGFR | IGF1R | 1.5 (50% max) | |
| DVD022 | IGF1R | EGFR | | 3.4 (65% max) |
| AB004 | | HER-2 | >67 (10% max) | |
| AB010 | | IGF1, 2 | >67 (10% max) | |
| DVD029 | HER-2 | IGF1, 2 | >50 (10% max) | |
| DVD030 | IGF1, 2 | HER-2 | >50 (10% max) | |
| AB004 | | HER-2 | >67 (10% max) | |
| AB011 | | IGF1R | >67 (5% max) | |
| DVD031 | HER-2 | IGF1R | >50 (10% max) | |
| DVD032 | IGF1R | HER-2 | >50 (10% max) | |
| AB014 | | VEGF | >67 (0%) | |
| AB010 | | IGF1, 2 | >67 (10% max) | |
| DVD041 | VEGF | IGF1, 2 | >50 (0%) | |

All DVD-Igs containing VDs from AB033, AB004, AB011, AB010, AB014 in either N-terminal or C-terminal position showed inhibition of A431 cell proliferation assay.

TABLE 13

GEO, EGFR/IGF1R Cell Line Proliferation Inhibition Assay With EGFR, IGF1R And IGF1, 2 Parent Antibodies And DVD-Ig Constructs

| Parent Antibody or DVD-Ig ID | N-terminal Variable Domain (VD) | C-terminal Variable Domain (VD) | N-terminal Proliferation Inhibition Cellular Assay IC50 nM (GEO, EGFR/IGF1R line) | C-terminal Proliferation Inhibition Cellular Assay IC50 nM (GEO, EGFR/IGF1R line) |
|---|---|---|---|---|
| AB033 | | EGFR | 0.2 (60% max) | |
| AB004 | | HER-2 | >67 (15% max) | |
| DVD015 | EGFR | HER-2 | 13 (60% max) | |
| DVD016 | HER-2 | EGFR | | 10 (40% max) |
| AB033 | | EGFR | 0.2 (60% max) | |
| AB011 | | IGF1R | >67 (15% max) | |
| DVD021 | EGFR | IGF1R | 0.32 (60% max) | 0.32 (60% max) |
| DVD022 | IGF1R | EGFR | 3.0 (40% max) | 3.0 (40% max) |
| AB004 | | HER-2 | >67 (15% max) | |
| AB010 | | IGF1, 2 | 20% at 67 nM | |
| DVD029 | HER-2 | IGF1, 2 | >50 (10% max) | >50 (10% max) |
| DVD030 | IGF1, 2 | HER-2 | >50 (10% max) | >50 (10% max) |
| AB004 | | HER-2 | >67 (15% max) | |
| AB011 | | IGF1R | >67 (15% max) | |
| DVD031 | HER-2 | IGF1R | >50 (10% max) | >50 (10% max) |
| DVD032 | IGF1R | HER-2 | >50 (10% max) | >50 (10% max) |

All DVD-Igs containing VDs from AB033, AB004, AB011, AB010, AB014 in either N-terminal or C-terminal position showed inhibition of GEO cell proliferation assay.

Example 1.1.2.H

Tumor Cell Growth Inhibitory Effect of HER2 Parent Antibody or DVD-Ig Constructs In Vitro HER2 monoclonal antibody or DVD-Igs diluted in D-PBS-BSA (Dulbecco's phosphate buffered saline with 0.1% BSA) 204, were added to HER2-expressing human tumor cells (BT474) at final concentrations of 0.01 µg/mL-100 µg/mL (180 µL). The plates were incubated at 37° C. in a humidified, 5% $CO_2$ atmosphere for three days. The number of live cells in each well was quantified using MTS reagents according to the manufacturer's instructions (Promega, Madison, Wis.) to determine the percent of tumor growth inhibition. Wells without antibody treatment were used as controls of 0% inhibition whereas wells without cells were considered to show 100% inhibition.

TABLE 14

BT474, Erb2(Her-2) Cell Line Proliferation Inhibition Assay With Anti-Her-2 Parent Antibodies And DVD-Ig Constructs

| Parent Antibody or DVD-Ig ID | N-terminal Variable Domain (VD) | C-terminal Variable Domain (VD) | N-terminal VD Proliferation Inhibition Cellular Assay IC50 nM (BT474, ErbB2 line) | C-terminal VD Proliferation Inhibition Cellular Assay IC50 nM (BT474, ErbB2 line) |
|---|---|---|---|---|
| AB004 | | HER-2 | 0.9 | |
| DVD015 | EGFR | HER-2 | | >50 |
| DVD016 | HER-2 | EGFR | 1.7 | |
| AB004 | | HER-2 | 0.9 | |
| DVD029 | HER-2 | IGF1, 2 | 2.7 | |
| DVD030 | IGF1, 2 | HER-2 | | >50 |
| AB004 | | HER-2 | 0.9 | |
| DVD031 | HER-2 | IGF1R | 2.2 | |
| DVD032 | IGF1R | HER-2 | | >50 |

All DVD-Igs containing VD from AB004 in either N-terminal or C-terminal position showed inhibition in the BT474 cell proliferation assay.

Example 1.1.2.I

Inhibition of Recombinant DLL4-Dependent Increase of Svegfr1 (Sflt1) in Eahy.926 Cells by DLL4 Parent Antibody and DVD-12 Constructs 96-well tissue culture plates were coated with 100 µl/well human DLL4 extracellular domain at 5 µg/ml in D-PBS (Gibco #14190, Grand Island, N.Y.) and incubated overnight at 4° C. Plates were washed once with D-PBS and 4000 EA.hy926 cells/well were seeded in the absence or presence of antibodies or DVD-Igs. Cell proliferation was measured four days later using the CyQUANT Cell Proliferation Assay Kit (Invitrogen, #C35007, Eugene, Oreg.). sVEGFR1 expression in the conditioned media was detected by an ELISA kit per the manufacturer's recommendations (R&D Systems #DVR100B, Minneapolis, Minn.). Levels of sVEGFR1 were normalized to the RFU determined by CyQUANT assay to account for differences in cell proliferation.

TABLE 15

Inhibition Of DLL4-Dependent Increase Of Svegfr1 (Sflt1) In Eahy.926 Cells By DLL4 Parent Antibodies Or DVD-Ig Constructs

| Parent Antibody or DVD-Ig ID | N-terminal Variable Domain (VD) | C-terminal Variable Domain (VD) | N-terminal VD Soluble Flt1 Assay (% of Neutralization @ nM Ab) | C-terminal VD Soluble Flt1 Assay (% of Neutralization @ nM Ab) |
|---|---|---|---|---|
| AB015 | | DLL-4 | 75.2% @9.2 nM, 86.6% @83.3 nM | 78.7% @27.7 nM, |
| DVD044 | DLL4 | VEGF | 39.8% @9.2 nM, 76.2% @27.7 nM, 79.9% @83.3 nM | |
| DVD043 | VEGF | DLL4 | | 1.1% @9.2 nM, 50.3% @27.7 nM, 57.9% @83.3 nM |

DVD-Igs containing VD from AB015 in either N-terminal or C-terminal position showed dose-dependent inhibition of sFLT release induced by DLL4 from Eahy.926 cells.

Example 1.1.2.J

Tumoricidal Effect of a Parent or DVD-Ig Antibody In Vitro

Parent antibodies or DVD-Ig that bind to target antigens on tumor cells may be analyzed for tumoricidal activity. Briefly, parent antibodies or DVD-Ig are diluted in D-PBS-BSA (Dulbecco's phosphate buffered saline with 0.1% BSA) and added to human tumor cells at final concentrations of 0.01 µg/mL to 100 µg/mL 200 µL. The plates are incubated at 37° C. in a humidified, 5% $CO_2$ atmosphere for 3 days. The number of live cells in each well is quantified using MTS reagents according to the manufacturer's instructions (Promega, Madison, Wis.) to determine the percent of tumor growth inhibition. Wells without antibody treatment are used as controls of 0% inhibition whereas wells without cells were considered to show 100% inhibition.

For assessment of apoptosis, caspase-3 activation was determined by the following protocol: antibody-treated cells in 96 well plates are lysed in 120 µl of 1× lysis buffer (1.67 mM Hepes, pH 7.4, 7 mM KCl, 0.83 mM $MgCl_2$, 0.11 mM EDTA, 0.11 mM EGTA, 0.57% CHAPS, 1 mM DTT, 1× protease inhibitor cocktail tablet; EDTA-free; Roche Pharmaceuticals, Nutley, N.J.) at room temperature with shaking for 20 minutes. After cell lysis, 80 µl of a caspase-3 reaction buffer (48 mM Hepes, pH 7.5, 252 mM sucrose, 0.1% CHAPS, 4 mM DTT, and 20 µM Ac-DEVD-AMC substrate; Biomol Research Labs, Inc., Plymouth Meeting, Pa.) is added and the plates are incubated for 2 hours at 37° C. The plates are read on a 1420 VICTOR Multilabel Counter (Perkin Elmer Life Sciences, Downers Grove, Ill.) using the following settings: excitation=360/40, emission=460/40. An increase of fluorescence units from antibody-treated cells relative to the isotype antibody control-treated cells is indicative of apoptosis.

Example 1.1.2.K

Inhibition of U87-MG Tumor Cell Proliferation by HGF Parent Antibody and DVD-Ig Constructs U87-MG human glioma tumor cells were plated at 2,000 cells/well in 100 µl in 96-well dishes in RPMI medium supplemented with 5% fetal bovine serum, and incubated at 37° C., 5% $CO_2$ overnight. The following day the cells were treated with serial dilutions of antibody or DVD-Igs (0.013 nM to 133 nM dose range), and incubated at 37° C. in a humidified, 5% $CO_2$ atmosphere for 5 days. Cell survival/proliferation was measured indirectly by assessing ATP levels using an ATPlite kit (Perkin Elmer, Waltham, Mass.) according to the manufacturer's instructions.

TABLE 16

U87-MG Tumor Proliferation Inhibition by anti-HGF Parent Antibody and DVD-Ig Constructs

| Parent Antibody or DVD-Ig ID | N-terminal Variable Domain (VD) | C-terminal Variable Domain (VD) | N-terminal VD inhibition of U87MG proliferation (EC50) | C-terminal VD inhibition of U87MG proliferation (EC50) |
|---|---|---|---|---|
| AB012 | | HGF | | 12 |
| DVD025 | EGFR | HGF | | >200 |
| AB012 | | HGF | | 12 |
| DVD033 | RON | HGF | | >200 |
| DVD034 | HGF | RON | 136 | |
| AB012 | | HGF | | 12 |
| DVD045 | VEGF | HGF | | >200 |
| AB008 | | CD22 | | >200 |

DVD-Igs containing a VD from AB012 in the C-terminal position or N-terminal position inhibited U87-MG tumor cell proliferation.

Example 1.1.2.L

Inhibition of RON Interaction with MSP1 by RON Parent Antibody and DVD-Ig Constructs In Vitro 96-well plates were coated with 50 µl/well of an anti-MSPα chain antibody (R&D Systems #MAB352, Minneapolis, Minn., 2 µg/mL), and plates were incubated overnight at 4° C. Plates were washed three times in wash buffer (PBS containing 0.05% Tween 20), and subsequently blocked with 100 µl/well of blocking buffer (PBS containing 2% BSA) for one hour at 25° C. Plates were then washed three times, and incubated with 50 µl/well of a 10 nM solution of recombinant human MSP1 (R&D Systems #352-MS, Minneapolis, Minn.) for one hour at 25° C. During plate incubation, serial 10-fold dilutions of the antibodies to be tested (0 nM to 1000 nM dose range) were pre-incubated with 10 nM recombinant His-RON partial ECD (R&D Systems #1947-MS, Minneapolis, Minn.) at 25° C. for one hour. Plates incubated with recombinant human MSP1 were washed three times, and 50 μl/well of the antibody/His-RON complexes were then added in triplicate. Following a one hour incubation at 25° C., the plates were then washed, and 50 μl/well of a TMB substrate (Pierce #34028, Rockford, Ill.) were added and incubated for five minutes at 25° C. The reaction was terminated after five minutes using 50 μl/well of 2N $H_2SO_4$. The absorbance was read at 450 nm (Spectra Max Plus plate reader, Molecular Devices, Sunnyvale, Calif.). EC50s were calculated in GraphPad Prism 4.03. The results are provided in Table 17 below.

Example 1.1.2.M

VEGF Parent Antibody and DVD-Ig Constructs Prevent $VEGF_{165}$ Interaction with VEGFR1

ELISA plates (Nunc, MaxiSorp, Rochester, N.Y.) were incubated overnight at 4° C. with 100 μl PBS containing recombinant VEGFR1 extra-cellular domain-Fc fusion protein (5 μg/ml, R&D systems, Minneapolis, Minn.). Plates were washed three times in washing buffer (PBS containing 0.05% Tween 20), and blocked for 1 hour at 25° C. in blocking buffer (PBS containing 1% BSA). Serial dilutions of each antibody/DVD-Ig in PBS containing 0.1% BSA were incubated with 50 μl of 2 nM biotinylated VEGF for 1 hour at 25° C. The antibody/DVD-Ig-biotinylated VEGF mixtures (100 μl) were then added to the VEGFR1-Fc coated wells and incubated at 25° C. for 10 minutes. The wells were washed three times, and then incubated for 1 hour at 25° C. with 100 μl of streptavidin-HRP (KPL #474-3000, Gaithersburg, Md.). The wells were washed three times, and 100 μl of ULTRA-TMB ELISA (Pierce, Rockford, Ill.) were added per well. Following color development the reaction was stopped with 1N HCL and absorbance at 450 nM was measured. The results are provided in Table 17 below.

Example 1.1.2.N

Inhibition of DLL4 Interaction with Notch-1 by DLL4 Parent Antibody and DVD-Ig Constructs In Vitro 96-well Nunc-Immuno plates (Nunc, #439-454, Rochester, N.Y.) were coated with 16 nM human Notch-1 (R&D Systems #3647-TK, Minneapolis, Minn., 100 μl/well in D-PBS) and incubated overnight at 4° C. Plates were then washed once with wash buffer (PBS, 0.05% Tween 20) and blocked with 200 μl/well blocking buffer (D-PBS, 1% BSA, 1 mM $CaCl_2$, 0.05% Tween 20) for 1 hour at 25° C. While blocking, 300 μl biotin labeled human DLL4 extracellular domain (14 nM) was mixed with antibody or DVD-Ig (3.4 pM-66 nM, 3-fold serial dilution in blocking buffer) for 1 hour at 25° C. Assay plates were washed after blocking, and incubated with DLL4 antibody or DVD-Ig mixtures (100 μl/well, 1 hour at 25° C.). Plates were washed again and 100 μl/well streptavidin conjugated with HRP (KPL #474-3000, Gaithersburg, Md., diluted 1:10,000 in blocking buffer) was added for 1 hour at 25° C. After a final wash, plates were developed using 100 μl/well substrate (1-Step Ultra TMB-ELISA, Pierce #340280, Rockford, Ill.), and the reaction was stopped after a 10-20 minute incubation at 25° C. using 100 μl/well 2N $H_2SO_4$, and the absorbance was read at 450 nm. The results are provided in Table 17 below.

Example 1.1.2.O

Inhibition of HGF Interaction with c-Met by HGF Parent Antibody and DVD-Ig Constructs ELISA plates (Nunc, MaxiSorp) were coated with 100 μl/well of recombinant human HGF (2 μg/ml of HGF in PBS, R&D systems) overnight at 4° C. Serial dilutions of each antibody/DVD-Ig and 2 nM soluble c-Met Fc fusion (R&D systems) (50 μl), were co-incubated and added to HGF coated wells. c-Met binding was detected with biotinylated anti-c-Met (BAF358, R&D Systems) and 100 μl of streptavidin-HRP (KPL). The wells were washed three times in PBST (PBS containing 0.05% Tween 20), and 100 μl of ULTRA-TMB ELISA (Pierce) were added per well. Following color development the reaction was stopped with 1N HCL and absorbance at 450 nM was measured. The data were evaluated by calculating the percentage inhibition compared with the maximal signal (control antibody or no antibody added) and the $IC_{50}$ values were calculated.

The following table contains the affinity data, expressed as IC50 in nM, of parent antibodies and DVD-Ig constructs in the ligand-receptor binding competition ELISA assays for RON, VEGF, DLL4, and HGF as described above.

TABLE 17

Inhibition Of Ligand-Receptor Interaction With RON. VEGF DLL4, And HGF Parent Antibodies And DVD-Ig Constructs In Vitro

| Parent Antibody or DVD-Ig ID | N-terminal Variable Domain (VD) | C-terminal Variable Domain (VD) | N-terminal VD Ligand-Receptor Binding Competition Assay (IC50, nM) | C-terminal VD Ligand-Receptor Binding Competition Assay (IC50, nM) |
|---|---|---|---|---|
| AB005 | | RON | 8.1 | |
| DVD024 | RON | EGFR | 9.6 | |
| DVD023 | EGFR | RON | | |
| AB005 | | RON | 0.32 | |
| DVD033 | RON | HGF | **0.0000097 | |
| DVD034 | HGF | RON | | |
| AB014 | | VEGF | 21.40 | |
| DVD035 | VEGF | EGFR | 23.90 | |
| AB014 | | VEGF | 21.40 | |
| DVD038 | HER-2 | VEGF | | 73.00 |
| AB015 | | DLL-4 | 0.37 | |
| AB014 | | VEGF | 21.4 | |
| DVD044 | DLL4 | VEGF | 0.50 | 143 |
| DVD043 | VEGF | DLL4 | 24.1 | 13.10 |
| AB005 | | RON | 0.1 | |
| AB014 | | VEGF | 21.4 | |
| DVD048 | RON | VEGF | 0.1127 | 114 |
| DVD047 | VEGF | RON | 30.5 | 21.28 |
| AB014 | | VEGF | 21.40 | |
| DVD050 | NRP1 | VEGF | | 79.00 |
| AB015 | | DLL-4 | 0.4 | |
| DVD257 | DLL4 | P1GF | 0.38 | |
| DVD258 | P1GF | DLL4 | | 17.47 |
| AB014 | | VEGF | 21.40 | |
| DVD260 | P1GF | VEGF | | 13.00 |
| AB012 | | HGF | 0.18 | |
| DVD025 | EGFR | HGF | | >100 |
| AB012 | | HGF | 0.18 | |

TABLE 17-continued

Inhibition Of Ligand-Receptor Interaction With RON. VEGF DLL4, And HGF Parent Antibodies And DVD-Ig Constructs In Vitro

| Parent Antibody or DVD-Ig ID | N-terminal Variable Domain (VD) | C-terminal Variable Domain (VD) | N-terminal VD Ligand-Receptor Binding Competition Assay (IC50, nM) | C-terminal VD Ligand-Receptor Binding Competition Assay (IC50, nM) |
|---|---|---|---|---|
| DVD045 | VEGF | HGF | | >100 |
| AB012 | | HGF | 0.18 | |
| DVD033 | RON | HGF | | 8.7 |
| DVD034 | HGF | RON | 0.34 | |

All DVD-Igs containing VD from AB005, AB015, AB015, AB012, in either N-terminal or C-terminal positions showed inhibition of ligand to their respective receptors. The N-terminal domain of DVD-Ig blocked ligand-receptor interaction as well as parent antibody.

Example 1.1.2.P

Inhibition of IGF-Induced IGFR Phosphorylation by Parent Antibodies or DVD-Ig Constructs In Vitro Human carcinoma cells were plated in 96-well plates at 40,000 cells/well in 180 µl serum-free medium (DMEM+ 0.1% BSA), and incubated overnight at 37° C., 5% $CO_2$. Costar EIA plates (Lowell, Mass.) were coated with 100 µl/well of IGFR capture Ab (R&D Systems cat #MAB391, Minneapolis, Minn., 4 µg/ml final concentration), and incubated overnight at room temperature while shaking. The following day, IGFR antibody-coated ELISA plates were washed (three times with PBST=0.05% Tween 20 in PBS, pH 7.2-7.4), and 200 µl blocking solution was added (1% BSA, 0.05% NaN3 in PBS, pH 7.2-7.4) to block for 2 hours at room temperature on a rocker. Human tumor cells were co-incubated with antibodies or DVD-Igs and IGF ligand. IGF1,2 monoclonal antibodies or DVD-Igs diluted in D-PBS-BSA (Dulbecco's phosphate buffered saline with 0.1% BSA) were added to human carcinoma cells at final concentrations of 0.01 µg/mL-100 µg/mL. Growth factors (IGF1 and IGF2) were simultaneously added to the cells at concentrations of 1-100 ng/mL (200 µL), and cells were incubated at 37° C. in a humidified, 5% $CO_2$ atmosphere for 1 hour. Cells were lysed in 120 µl/well of cold cell extraction buffer (10 mM Tris, pH 7.4, 100 mM NaCl, 1 mM EDTA, 1 mM EGTA, 1 mM NaF, 1 mM sodium orthovanadate, 1% Triton X-100, 10% Glycerol, 0.1% SDS, and protease inhibitor cocktail), and incubated at 4° C. for 20 minutes with shaking. Cell lysates (1000 were added to the ELISA plate, and incubated overnight at 4° C. with gentle shaking. The following day, ELISA plates were washed, and 100 µl/well of pTyr-HRP detection Ab was added (p-IGF1R ELISA kit, R&D System # DYC1770, Minneapolis, Minn.), and plates were incubated for 2 hours at 25° C. in the dark. Plates were developed to determine phospho-IGF1R per the manufacturer's instructions. Results are shown in Tables 18 and 19.

TABLE 18

Inhibition Of IGF1R Phosphorylation By IGF1 With Anti-IGF1, 2 Parent Antibodies Or DVD-Ig Constructs

| Parent Antibody or DVD-Ig ID | N-terminal Variable Domain (VD) | C-terminal Variable Domain (VD) | N-terminal VD pIGF1R Cellular Assay (hIGF1 Neutralization IC50 nM) | C-terminal VD pIGF1R Cellular Assay (hIGF1 Neutralization IC50 nM) |
|---|---|---|---|---|
| AB010 | IGF1, 2 | | 1.7 | |
| DVD029 | HER-2 | IGF1, 2 | | 14.22 (40% max) |
| DVD030 | IGF1, 2 | HER-2 | 1.9 | |
| AB010 | IGF1, 2 | | 1.7 | |
| DVD041 | VEGF | IGF1, 2 | | 16.8 (40% max) |
| DVD042 | IGF1, 2 | VEGF | 1.8 | |

DVD-Igs containing the VD from AB010 in either the N-terminal or the C-terminal position showed inhibition of IGF1-induced IGF1R receptor phosphorylation. The VD of AB010 in N-terminal position of DVD-Ig blocked receptor phosphorylation as well as parent antibody AB010.

TABLE 19

Inhibition Of IGF1R Phosphorylation By IGF2 With Anti-IGF1, 2 Parent Antibodies Or DVD-Ig Constructs

| Parent Antibody or DVD-Ig ID | N-terminal Variable Domain (VD) | C-terminal Variable Domain (VD) | N-terminal VD pIGFR1 Cellular Assay (IGF2 induced IC50 nM) | C-terminal VD pIGFR1 Cellular Assay (IGF2 induced IC50 nM |
|---|---|---|---|---|
| AB010 | IGF1, 2 | | | 0.3 |
| DVD029 | HER-2 | IGF1, 2 | ND | 1.9 |
| DVD030 | IGF1, 2 | HER-2 | 0.4 | ND |
| AB010 | IGF1, 2 | | | 0.3 |
| DVD041 | VEGF | IGF1, 2 | ND | 1.5 |
| DVD042 | IGF1, 2 | VEGF | 0.3 | ND |

DVD-Igs containing the VD from AB010 in either the N-terminal or the C-terminal position showed inhibition of IGF2-induced IGF1R receptor phosphorylation. The VD of AB010 in the N-terminal position of DVD-Ig blocked receptor phosphorylation as well as parent antibody AB010.

Example 1.1.2.Q

Inhibition of HGF-Mediated Phosphorylation of Akt by HGF Parent Antibody and DVD-12 Constructs H1299 non-small cell lung tumor cells were plated at 20,000 cells/well (100 µl total volume) in 96-well plates and serum starved for 18 hours at 37° C., 5% $CO_2$. Anti-HGF monoclonal antibodies or DVD-Igs (final concentrations of 67 nM, 6.7 nM, and 0.67 nM) were diluted in Dulbecco's Minimal Essential Media containing 0.1% BSA and were pre-incubated with recombinant human HGF (50 ng/ml) in 50 µl for 1 hour at 25° C. These antibody/DVD-Ig and HGF mixtures (50 µl) were then added to the cells, and the plates were incubated at 37° C. in a humidified, 5% $CO_2$ atmosphere for approximately 15 minutes. The cells were then fixed by adding an equal volume of 7.6% formaldehyde to each well and the plates were incubated for 15 minutes at 25° C. Following fixation, the cells were washed five times in PBS containing 0.1% Triton X-100. The cells were then treated with 150 µl of LI-COR Odyssey Blocking Buffer (Li-Cor Biosciences, Lincoln, Nebr.) per well, and incubated for 90 minutes at room temperature with moderate shaking. The blocking buffer was removed and the cells were incubated at 4° C. overnight with primary antibody diluted in blocking buffer (1:300 dilution Phospho Ser473-Akt, Cell Signaling Technology #4060, Boston, Mass.). The wells were then washed five times with PBS containing 0.1% Tween 20, and then incubated with secondary antibody (1:400 dilution of an anti-rabbit IRDye™ 680CW LI-COR (Li-Cor Biosciences, Lincoln, Nebr.) in 1×PBS with 0.2% Tween 20) for 1 hour at 25° C. The cells were washed five times with PBS containing 0.1% Tween 20, and imaged using an Odyssey Infrared Imaging System.

TABLE 20

Inhibition Of HGF-Mediated Phosphorylation Of Akt By HGF Parent Antibody And DVD-Ig Constructs

| Parent Antibody or DVD-Ig ID | N-terminal Variable Domain (VD) | C-terminal Variable Domain (VD) | N-Terminal VD Inhibition Of Akt Phosphorylation (% Inhibition At 67, 6.7 And 0.67 nM Ab/DVD) | C-Terminal VD Inhibition Of Akt Phosphorylation (% Inhibition At 67, 6.7 And 0.67 nm Ab/DVD) |
|---|---|---|---|---|
| AB012 | | HGF | | 67 nM = 106%, 6.7 nM = 110%, 0.67 nM = 79% |
| DVD033 | RON | HGF | | 67 nM = 95%, 6.7 nM = 91%, 0.67 nM = 24% |
| DVD034 | HGF | RON | 67 nM = 111%, 6.7 nM = 105%, 0.67 nM = 99% | |
| AB012 | | HGF | | 67 nM = 106%, 6.7 nM = 110%, 0.67 nM = 79% |
| DVD045 | VEGF | HGF | | 67 nM = 64%, 6.7 nM = −2%, 0.67 nM = −15% |
| AB008 | | CD22 | | 67 nM = 8%, 6.7 nM = −13% |

DVD-Igs containing the VD from AB012 in either the N-terminal or the C-terminal position showed good inhibition of HGF-induced Akt phosphorylation. The VD of AB012 in the N-terminal position of DVD-Ig blocked Akt phosphorylation as well as parent antibody AB012.

Example 1.1.2.R

Inhibition of VEGFR2 (KDR) Phosphorylation by VEGF Parent Antibody and DVD-Ig Constructs NIH3T3 cells expressing human VEGFR2 (KDR) were plated at 20,000 cells/well (100 µl) in 96-well plates in DMEM supplemented with 10% FBS. The following day, the cells were washed twice with DMEM and serum-starved for three hours in DMEM without FBS. Anti-VEGF parent antibody or DVD-Igs (at final concentrations of 67 nM, 6.7 nM and 0.67 nM) diluted in DMEM with 0.1% BSA were pre-incubated with recombinant human $VEGF_{165}$ (50 ng/ml) for 1 hour at 25° C. These antibody/DVD-Ig and VEGF mixtures were then added to the cells, and the plates were incubated at 37° C. in a humidified, 5% $CO_2$ atmosphere for 10 minutes. Cells were washed twice with ice cold PBS and lysed by addition of 100 µl/well of Cell Lysis Buffer (Cell Signaling, Boston, Mass.) supplemented with 0.1% NP40. Duplicate samples were pooled and 170 µl was added to wells of ELISA plates previously coated with anti-VEGFR2 antibody (R&D systems, AF357, Minneapolis, Minn.) and incubated at 25° C. with gentle shaking for two hours. The wells were washed five times with washing buffer (PBS containing 0.05% Tween 20), and incubated with 50 µl of 1:2000 dilution of biotinylated anti-phosphotyrosine antibody (4G10; Millipore, Billerica, Mass.) for 1 hour at 25° C. The wells were washed five times with PBS containing 0.05% Tween 20, and then incubated for 1 hour at 25° C. with streptavidin-HRP (KPL #474-3000, Gaithersburg, Md.). The wells were washed three times with streptavidin-HRP (KPL #474-3000, Gaithersburg, Md.)). The wells were washed three times with PBS containing 0.05% Tween 20, and 100 µl of ULTRA-TMB ELISA (Pierce, Rockford, Ill.) were added per well. Following color development the reaction was stopped with 1N HCL and absorbance at 450 nM was measured. The results are shown in Table 21.

TABLE 21

Inhibition Of VEGFR2 (KDR) Phosphorylation By VEGF Parent Antibodies Or DVD-Ig Constructs

| Parent Antibody or DVD-Ig ID | C-terminal Variable Domain (VD) | N-terminal Variable Domain (VD) | N-Terminal VD Inhibition Of Pkdr (EC50) | C-Terminal VD Inhibition Of Pkdr (EC50) |
|---|---|---|---|---|
| AB014 | | VEGF | | 0.45 |
| DVD044 | DLL4 | VEGF | | 10.40 |
| DVD043 | VEGF | DLL4 | 0.54 | |
| AB014 | | VEGF | | 0.45 |
| DVD048 | RON | VEGF | | 31.80 |
| DVD047 | VEGF | RON | 0.47 | |

DVD-Igs containing the VD from AB014 in either N-terminal or the C-terminal position showed good inhibition of VEGF-induced KDR phosphorylation. The VD of AB014 in the N-terminal position of DVD-Ig blocked KDR phosphorylation as well as parent antibody AB014.

Example 1.1.2.S

Inhibition of EGF-Induced EGFR Phosphorylation by EGFR Parent Antibody or DVD-Ig Constructs In Vitro EGFR monoclonal antibodies or DVD-Igs diluted in D-PBS-BSA (Dulbecco's phosphate buffered saline with 0.1% BSA) were added to human carcinoma cells at final concentrations of 0.01 µg/mL-100 µg/mL (180 µL). The plates were incubated at 37° C. in a humidified, 5% $CO_2$ atmosphere for 1 hour. Growth factors (EGF) at a final concentration of 1-100 ng/mL (20 µL) were added to the cells for 5-15 minutes to stimulate receptor (EGFR) autophosphorylation. Wells without antibody treatment were used as controls of 0% inhibition whereas wells without growth factor stimulation were considered to show 100% inhibition. Cell lysates were made by incubation with cell extraction buffer (10 mM Tris, pH 7.4, 100 mM NaCl, 1 mM EDTA, 1 mM EGTA, 1 mM NaF, 1 mM sodium orthovanadate, 1% Triton X-100, 10% Glycerol, 0.1% SDS, and protease inhibitor cocktail). Phospho-EGFR in these cell lysates was determined using the p-EGFR ELISA kit from R&D Systems (#DYC1095, Minneapolis, Minn.) according to the manufacturer's instructions. Results are shown in Tables 22 and 23.

TABLE 22

Inhibition Of EGF-Induced EGFR Phosphorylation By Anti-EGFR Parent Antibodies And DVD-Ig Constructs

| Parent Antibody or DVD-Ig ID | N-terminal Variable Domain (VD) | C-terminal Variable Domain (VD) | N-terminal VD pEGFR Cellular Assay (EGF induced IC50 nM) | C-terminal VD pEGFR Cellular Assay (EGF induced IC50 nM)) |
|---|---|---|---|---|
| AB033 | | EGFR | | 7.3 |
| DVD015 | EGFR | HER-2 | 7.9 | |
| DVD016 | HER-2 | EGFR | | >50 (10% max) |
| AB033 | | EGFR | | 7.3 |
| DVD021 | EGFR | IGF1R | 7.7 | |
| DVD022 | IGF1R | EGFR | | >50 (20% max) |

DVD-Igs containing the VD from AB033 in either the N-terminal or the C-terminal position showed good inhibition of EGF-induced EGFR phosphorylation. The VD of AB033 in the N-terminal position of DVD-Ig (DVD015, DVD021) blocked EGFR phosphorylation as well as parent antibody AB033.

TABLE 23

Inhibition Of EGF-Induced EGFR Phosphorylation By Anti-EGFR Parent Antibodies And DVD-Ig Constructs

| Parent Antibody or DVD-Ig ID | N-terminal Variable Domain (VD) | C-terminal Variable Domain (VD) | N-Terminal Cellular Assay, Inhibition Of EGF-Induced phEGFR (IC50, nM) | C-Terminal Cellular Assay, Inhibition Of EGF-Induced phEGFR (IC50, nM) |
|---|---|---|---|---|
| AB033 | | EGFR | | 0.35 |
| DVD024 | RON | EGFR | ND | 7.143 |
| DVD023 | EGFR | RON | 0.54 | ND |

DVD-Igs containing the VD from AB033 in either the N-terminal or the C-terminal position showed good inhibition of EGF-induced EGFR phosphorylation. The VD of AB033 in the N-terminal position of DVD-Ig (DVD023) blocked EGFR phosphorylation as well as parent antibody AB033.

Example 1.1.2.T

Inhibition of MSP1-Induced ERK1/2 and AKT Phosphorylation In Vitro by Parent RON Antibody and DVD-Ig Constructs Sub-confluent DU145 colon tumor cells grown in 10% FBS/Minimal Essential Medium were trypsinized and seeded into 6-well tissue culture plates ($0.25 \times 10^6$ cells/2 ml final volume), and incubated at 37° C., 5% $CO_2$ for 18-24 hours. After incubation, the cells were washed twice with 1×D-PBS and starved overnight in serum-free medium. The next day, cells were incubated with 900 µl of serum-free media containing 1 µM of monoclonal antibodies or DVD-Igs for 1 hour at 37° C. Following antibody incubation, cells were then treated with 13 nM MSP1 (37° C., 30 minutes). Cells were washed twice with ice-cold D-PBS and harvested in 150 µl Cell Extraction Buffer (Biosource International, Carlsbad, Calif.) containing 100 µl of HALT® phosphatase inhibitor cocktail (Thermo Scientific, Rockford, Ill.), one Complete® EDTA-free protease inhibitor tablet (1 tablet/10 ml, Roche Diagnostic, Mannheim, Germany), and PMSF. Cell lysates were incubated on ice for 30 minutes with intermittent vortexing, pre-cleared by centrifugation (10 min, 14,000 RPM, 4° C.), and processed for Western blot analysis. A total of 15 µg of cell lysate was resolved by SDS-PAGE on a 4-12% NuPage Bis-Tris Gel with 1×MOPS running buffer (Invitrogen, Carlsbad, Calif.). Proteins were transferred onto a nitrocellulose membrane (Invitrogen, Carlsbad, Calif.), and blocked in 5% nonfat milk in TBS-T (1×TBS/0.1% Tween 20) for 1 hour at room temperature. After blocking, membranes were incubated overnight at 4° C. with a 1:1000 dilution of either a rabbit polyclonal phospho-p44/42 MAPK ($Thr^{202}/Tyr^{204}$) antibody (Cell Signaling, Danvers, Mass.) or a rabbit monoclonal phospho-AKT ($Ser^{473}$) antibody (Cell Signaling, Danvers, Mass.). Blots were washed three times (1×TBS-T, 15 minutes), and incubated for 1 hour at room temperature with a 1:5000 dilution of anti-rabbit IgG, HRP-conjugated secondary goat antibody (Jackson Immunoresearch, West Grove, Pa.) in a 5% nonfat milk/TBS-T solution. The blots were washed three times (1×TBS-T, 15 min), and peroxidase conjugated secondary antibody was activated by a 5 min. incubation with SuperSignal West Dura Luminol/Enhancer Solution® (Millipore, Temecula, Calif.), and chemiluminescence was detected and quantified with a Luminescent Image Analyzer LAS-3000 (FUJIFilm, Tokyo, Japan). Band density was determined using MultiGauge Software (FUJIFilm, Tokyo, Japan) and the total chemiluminescent signal was quantified for each band. To determine total ERK1/2 and AKT levels, membranes were stripped for 15 minute with 1× Reblot Plus Strong Solution® (Thermo Scientific, Rockford, Ill.) and reprobed with a 1:1000 dilution of either a rabbit polyclonal p44/42 MAPK antibody (Cell Signaling, Danvers, Mass.) or a rabbit monoclonal AKT antibody (Cell Signaling, Danvers, Mass.), and processed as described above for phospho-antibodies. Ph-ERK and ph-Akt levels were standardized to total ERK or total Akt, respectively.

TABLE 24

Inhibition Of MSP1-Induced ERK1/2 Phosphorylation By RON Parent Antibodies Or DVD-Ig Constructs

| Parent Antibody or DVD-Ig ID | N-terminal Variable Domain (VD) | C-terminal Variable Domain (VD) | N-Terminal VD Cellular Assay, Inhibition Of RON-Induced phERK1/2 (% of neutralization @ nM Ab) | C-Terminal VD Cellular Assay, Inhibition Of RON-Induced phERK1/2 (% of neutralization @ nM Ab) |
|---|---|---|---|---|
| AB005 | | RON | | 80% at 1000 nM |
| DVD024 | RON | EGFR | 97% at 1000 nM | |
| AB005 | | RON | | 80% at 1000 nM |
| DVD033 | RON | HGF | 60% at 1000 nM | |

DVD-Igs containing the VD from AB005 in the N-terminal position showed excellent inhibition of MSP1-induced ERK1/2 phosphorylation. The inhibition profile of DVD024 and DVD033 was similar to the inhibition profile of parent antibody AB005.

Example 1.1.2.U

Efficacy of a DVD-Ig on the Growth of Human Carcinoma Subcutaneous Flank Xenografts A-431 human epidermoid carcinoma cells were grown in vitro to 99% viability, 85% confluence in tissue culture flasks. SCID female mice (Charles Rivers Labs, Wilmington, Mass.) at 19-25 grams were injected subcutaneously into the right flank with $1\times10^6$ human tumor cells (1:1 matrigel) on study day 0. Administration (IP, QD, 3x/week) of human IgG control or DVD-Ig was initiated after mice were size matched into groups of mice with mean tumor volumes of approximately 200 to 320 mm$^3$. The tumors were measured twice a week starting on approximately day 10 post tumor cell injection Reduction in tumor volume was seen in animals administered EGFR+IGF1/2 DVD Ig relative to tumors in animals that received only control IgG. For two different EGFR+ IGF1/2 DVD Ig constructs, % TGIs were 69 and 64 as measured four days after the end of the 3 week dosing phase.

Example 1.1.2.V

Binding of Monoclonal Antibodies to the Surface of Human Tumor Cell Lines as Assessed by Flow Cytometry Stable cell lines overexpressing a cell-surface antigen of interest or human tumor cell lines were harvested from tissue culture flasks and resuspended in phosphate buffered saline (PBS) containing 5% fetal bovine serum (PBS/FBS). Prior to staining, human tumor cells were incubated on ice with (100 µl) human IgG at 5 µg/ml in PBS/FCS. $1-5\times10^5$ cells were incubated with antibody or DVD-Ig (2 µg/mL) in PBS/FBS for 30-60 minutes on ice. Cells were washed twice and 100 µl of F(ab')2 goat anti human IgG, Fcγ-phycoerythrin (1:200 dilution in PBS) (Jackson ImmunoResearch, West Grove, Pa., Cat. #109-116-170) was added. After 30 minutes incubation on ice, cells were washed twice and resuspended in PBS/FBS. Fluorescence was measured using a Becton Dickinson FACSCalibur (Becton Dickinson, San Jose, Calif.).

Table 25 shows the FACS data for the DVD-Ig constructs. The geometric mean is the n root of the multiplication product of n fluorescent signals (a1×a2×a3 . . . an). With log-transformed data the geometric mean is used to normalize the weighting of the data distribution. The following table contains the FACS geometric mean of parent antibodies and DVD-Ig constructs.

TABLE 25

Fluorescent Activated Cell Sorting of DVD-Ig Constructs

| Parent Antibody or DVD-Ig ID | N-terminal Variable Domain (VD) | C-terminal Variable Domain (VD) | FACS Geometric Mean N-terminal | FACS Geometric Mean C-terminal |
| --- | --- | --- | --- | --- |
| AB006 | | CD-19 | | 979 |
| AB001 | | CD-20 | | |
| DVD001 | CD-20 | CD-19 | | 161 |
| DVD002 | CD-19 | CD20 | 1102 | |
| AB001 | | CD-20 | | 95.8 |
| AB002 | | CD-3 | | 461 |
| DVD003 | CD-20 | CD-3 | 45.9 | 5.7 |
| DVD004 | CD-3 | CD-20 | 673 | 3.59 |
| AB007 | | CD-80 | | 25.4 |
| AB001 | | CD-20 | | |
| DVD005 | CD-20 | CD-80 | | 6 |
| DVD006 | CD-80 | CD-20 | 70.7 | |
| AB002 | | CD-3 | | 897 |
| AB004 | | HER-2 | | 27.7 |
| DVD011 | CD-3 | HER-2 | 1096 | 3.39 |
| DVD012 | HER-2 | CD-3 | 7.14 | 41.6 |
| AB002 | | CD-3 | | 461/897 |
| AB006 | | CD-19 | | 661/989 |
| DVD013 | CD-3 | CD-19 | 417 | 103 |
| DVD014 | CD-19 | CD-3 | 1090 | 23.3 |
| AB033 | | EGFR | | 955.4 |
| AB004 | | HER-2 | | 24.77 |
| DVD015 | EGFR | HER-2 | 1006.4 | 200.07 |
| DVD016 | HER-2 | EGFR | 75.67 | 384.4 |
| AB033 | | EGFR | | 955.4 |
| AB011 | | IGF1R | | 1684.5 |
| DVD021 | EGFR | IGF1R | 888.4 | 733.5 |
| DVD022 | IGF1R | EGFR | 2016.5 | 411.4 |
| AB005 | | RON | | 54.46 |
| AB033 | | EGFR | | 955.4 |
| DVD024 | RON | EGFR | 0.38 | 309.4 |
| DVD023 | EGFR | RON | 1001.4 | 164.96 |
| AB033 | | EGFR | | 955.4 |
| AB012 | | HGF | | |
| DVD025 | EGFR | HGF | 1045.4 | |
| DVD026 | HGF | EGFR | | 143.4 |
| AB004 | | HER-2 | | 24.77 |
| AB010 | | IGF1, 2 | | |
| DVD029 | HER-2 | IGF1, 2 | 22.37 | |
| DVD030 | IGF1, 2 | HER-2 | | 0.23 |
| AB004 | | HER-2 | | 24.77 |
| AB011 | | IGF1R | | 1684.5 |
| DVD031 | HER-2 | IGF1R | 4.99 | 24.7 |
| DVD032 | IGF1R | HER-2 | 34.6 | 4.9 |
| AB005 | | RON | | 54.46 |
| AB012 | | HGF | | |
| DVD033 | RON | HGF | 6.46 | |
| DVD034 | HGF | RON | | 0.39 |
| AB014 | | VEGF | | |
| AB033 | | EGFR | | 955.4 |
| DVD035 | VEGF | EGFR | | 162.4 |
| DVD036 | EGFR | VEGF | 1081.4 | |
| AB014 | | VEGF | | |
| AB004 | | HER-2 | | 24.77 |
| DVD037 | VEGF | HER-2 | | 1.03 |
| DVD038 | HER-2 | VEGF | 7.47 | |
| AB015 | | DLL-4 | | 308.27 |
| AB014 | | VEGF | | |
| DVD044 | DLL4 | VEGF | 297.27 | |
| DVD043 | VEGF | DLL4 | | 68.37 |
| AB014 | | VEGF | | |
| AB012 | | HGF | | |
| DVD045 | VEGF | HGF | | |
| DVD046 | HGF | VEGF | | |
| AB005 | | RON | | 54.46 |
| AB014 | | VEGF | | |
| DVD048 | RON | VEGF | 29.86 | |
| DVD047 | VEGF | RON | | 0.51 |
| AB014 | | VEGF | | |
| AB016 | | NRP1 | | 338.4 |
| DVD049 | VEGF | NRP1 | | 352.4 |
| DVD050 | NRP1 | VEGF | 336.4 | |
| AB015 | | DLL-4 | | 308.27 |
| AB047 | | P1GF | | |
| DVD257 | DLL4 | P1GF | 274.27 | |
| DVD258 | P1GF | DLL4 | | 5.57 |

All DVDs showed binding to their cell surface targets. The N-terminal domains of DVDs bound their targets on the cell surface as well as or better than the parent antibody. Binding can be restored or improved by adjusting linker length.

Example 1.1.2.W

Binding of Parent EGFR Antibody and DVD-Ig Constructs to the Surface of Human Tumor Cell Lines as Assessed by Flow Cytometry Stable cell lines overexpressing cell-surface EGFR or human tumor cell lines were harvested from tissue culture flasks and resuspended in Dulbecco's phosphate buffered saline (DPBS) containing 1% fetal calf serum (DPBS/FCS). $1-5\times10^5$ cells were incubated with 100 μL antibodies or DVD-Igs (10 ug/mL) in DPBS/FCS for 30-60 minutes on ice. Cells were washed twice and 50 μl of goat anti-human IgG-phycoerythrin (1:50 dilution in DPBS/BSA) (Southern Biotech Associates, Birmingham, Ala. cat#2040-09) was added. After 30-45 minutes incubation on ice, cells were washed twice and resuspended in 125 uL/well 1% formaldehyde in DPBS/FCS. Fluorescence was measured using a Becton Dickinson LSRII (Becton Dickinson, San Jose, Calif.).

TABLE 26

Binding Affinity of anti-EGFR Parent Antibodies and DVD-Ig Constructs to A431, EGFR Cell Line by FACS

| Parent Antibody or DVD-Ig ID | N-terminal Variable Domain (VD) | C-terminal Variable Domain (VD) | N-terminal VD Ag binding A431 FACS (EC50, nM) | C-terminal VD Ag binding A431 FACS (EC50, nM) |
|---|---|---|---|---|
| AB005 |  | RON |  |  |
| AB033 |  | EGFR | 4.2 |  |
| DVD024 | RON | EGFR | ND | 25.43 |
| DVD023 | EGFR | RON | 5.38 | ND |

All DVDs bound to their cell surface targets. The N-terminal domains of DVDs bound their targets on the cell surface as well as the parent antibody.

TABLE 27

Binding Affinity of anti-EGFR Parent Antibodies and DVD-Ig Constructs to BAFvar3 Cell Line by FACS

| Parent Antibody or DVD-Ig ID | N-terminal Variable Domain (VD) | C-terminal Variable Domain (VD) | N-terminal VD Ag binding BAFvar3 FACS (EC50, nM) | C-terminal VD Ag binding BAFvar3 FACS (EC50, nM) |
|---|---|---|---|---|
| AB005 |  | RON |  |  |
| AB033 |  | EGFR | 0.5 |  |
| DVD024 | RON | EGFR | ND | 17.8 |
| DVD023 | EGFR | RON | 0.6 | ND |

All DVDs bound to their cell surface targets. The N-terminal domains of DVDs bound their targets on the cell surface as well as the parent antibody.

Example 1.2

Generation of Parent Monoclonal Antibodies to a Human Antigen of Interest

Parent mouse mAbs able to bind to and neutralize a human antigen of interest and a variant thereof are obtained as follows:

Example 1.2.A

Immunization of Mice With a Human Antigen of Interest

Twenty micrograms of recombinant purified human antigen (e.g., IGF1,2) mixed with complete Freund's adjuvant or Immunoeasy adjuvant (Qiagen, Valencia, Calif.) is injected subcutaneously into five 6-8 week-old Balb/C, five C57B/6 mice, and five AJ mice on Day 1. On days 24, 38, and 49, twenty micrograms of recombinant purified human antigen variant mixed with incomplete Freund's adjuvant or Immunoeasy adjuvant is injected subcutaneously into the same mice. On day 84 or day 112 or day 144, mice are injected intravenously with 1 μg recombinant purified human antigen of interest.

Example 1.2.B

Generation of a Hybridoma

Splenocytes obtained from the immunized mice described in Example 1.2.A are fused with SP2/O-Ag-14 cells at a ratio of 5:1 according to the established method described in Kohler, G. and Milstein (1975) Nature, 256:495 to generate hybridomas. Fusion products are plated in selection media containing azaserine and hypoxanthine in 96-well plates at a density of $2.5\times10^6$ spleen cells per well. Seven to ten days post fusion, macroscopic hybridoma colonies are observed. Supernatant from each well containing hybridoma colonies is tested by ELISA for the presence of antibody to the antigen of interest (as described in Example 1.1.1.A). Supernatants displaying antigen-specific activity are then tested for activity (as described in the assays of Example 1.1.2), for example, the ability to neutralize the antigen of interest in a bioassay such as that described in Example 1.1.2.I).

Example 1.2.C

Identification and Characterization of Parent Monoclonal Antibodies to a Human Target Antigen of Interest Example 1.2.C.1

Analyzing Parent Monoclonal Antibody Neutralizing Activity

Hybridoma supernatants are assayed for the presence of parent antibodies that bind an antigen of interest, generated according to Examples 1.2.A and 1.2.B, and are also capable of binding a variant of the antigen of interest ("antigen variant"). Supernatants with antibodies positive in both assays are then tested for their antigen neutralization potency, for example, in the cytokine bioassay of Example 1.1.2.I. The hybridomas producing antibodies with $IC_{50}$ values in the bioassay less than 1000 pM, in an embodiment, less than 100 pM are scaled up and cloned by limiting dilution. Hybridoma cells are expanded into media containing 10% low IgG fetal bovine serum (Hyclone #SH30151, Logan, Utah). On average, 250 mL of each hybridoma supernatant (derived from a clonal population) is harvested, concentrated and purified by protein A affinity chromatography, as described in Harlow, E. and Lane, D. 1988 "Antibodies: A Laboratory Manual". The ability of purified mAbs to inhibit the activity of its target antigen is determined, for example, using the cytokine bioassay as described in Example 1.1.2.1.

Example 1.2.C.2

Analyzing Parent Monoclonal Antibody Cross-Reactivity to Cynomolgus Target Antigen of Interest To determine whether the selected mAbs described herein recognize cynomolgus antigen of interest, BIACORE analysis is conducted as described herein (Example 1.1.1.G) using recombinant cynomolgus target antigen. In addition, neutralization potencies of mAbs against recombinant cynomolgus antigen of interest may also be measured in the cytokine bioassay (Example 1.1.2.I). MAbs with good cyno cross-reactivity (in an embodiment, within 5-fold of reactivity for human antigen) are selected for future characterization.

Example 1.2.D

Determination of the Amino Acid Sequence of the Variable Region for Each Murine Anti-Human Monoclonal Antibody Isolation of the cDNAs, expression and characterization of the recombinant anti-human mouse mAbs is conducted as follows. For each amino acid sequence determination, approximately $1\times10^6$ hybridoma cells are isolated by centrifugation and processed to isolate total RNA with Trizol (Gibco BRL/Invitrogen, Carlsbad, Calif.) following manufacturer's instructions. Total RNA is subjected to first strand DNA synthesis using the SuperScript First-Strand Synthesis System (Invitrogen, Carlsbad, Calif.) per the manufacturer's instructions. Oligo(dT) is used to prime first-strand synthesis to select for poly(A)+ RNA. The first-strand cDNA product is then amplified by PCR with primers designed for amplification of murine immunoglobulin variable regions (Ig-Primer Sets, Novagen, Madison, Wis.). PCR products are resolved on an agarose gel, excised, purified, and then subcloned with the TOPO Cloning kit into pCR2.1-TOPO vector (Invitrogen, Carlsbad, Calif.) and transformed into TOP10 chemically competent *E. coli* (Invitrogen, Carlsbad, Calif.). Colony PCR is performed on the transformants to identify clones containing insert. Plasmid DNA is isolated from clones containing insert using a QIAprep Miniprep kit (Qiagen, Valencia, Calif.). Inserts in the plasmids are sequenced on both strands to determine the variable heavy or variable light chain DNA sequences using M13 forward and M13 reverse primers (Fermentas Life Sciences, Hanover Md.). Variable heavy and variable light chain sequences of the mAbs are identified. In an embodiment, the selection criteria for a panel of lead mAbs for next step development (humanization) includes the following:

The antibody does not contain any N-linked glycosylation sites (NXS), except from the standard one in CH2

The antibody does not contain any extra cysteines in addition to the normal cysteines in every antibody The antibody sequence is aligned with the closest human germline sequences for VH and VL and any unusual amino acids should be checked for occurrence in other natural human antibodies N-terminal Glutamine (Q) is changed to Glutamic acid (E) if it does not affect the activity of the antibody. This will reduce heterogeneity due to cyclization of Q Efficient signal sequence cleavage is confirmed by Mass Spectrophotometry. This can be done with COS cell or 293 cell material The protein sequence is checked for the risk of deamidation of Asn that could result in loss of activity The antibody has a low level of aggregation The antibody has solubility >5-10 mg/ml (in research phase); >25 mg/ml The antibody has a normal size (5-6 nm) by Dynamic Light Scattering (DLS)

The antibody has a low charge heterogeneity

The antibody lacks cytokine release (see Example 1.1.2.B)

The antibody has specificity for the intended cytokine (see Example 1.1.2.C)

The antibody lacks unexpected tissue cross reactivity (see Example 1.1.2.D)

The antibody has similarity between human and cynomolgus tissue cross reactivity (see Example 1.1.2.D)

Example 1.2.2

Recombinant Humanized Parent Antibodies

Example 1.2.2.1

Construction and Expression of Recombinant Chimeric Anti Human Parent Antibodies The DNA encoding the heavy chain constant region of murine anti-human parent mAbs is replaced by a cDNA fragment encoding the human IgG1 constant region containing 2 hinge-region amino acid mutations by homologous recombination in bacteria. These mutations are a leucine to alanine change at position 234 (EU numbering) and a leucine to alanine change at position 235 (Lund et al., 1991, J. Immunol., 147:2657). The light chain constant region of each of these antibodies is replaced by a human kappa constant region. Full-length chimeric antibodies are transiently expressed in COS cells by co-transfection of chimeric heavy and light chain cDNAs ligated into the pBOS expression plasmid (Mizushima and Nagata, Nucleic Acids Research 1990, Vol 18, pg 5322). Cell supernatants containing recombinant chimeric antibody are purified by Protein A Sepharose chromatography and bound antibody is eluted by addition of acid buffer. Antibodies are neutralized and dialyzed into PBS.

The heavy chain cDNA encoding a chimeric mAb is co-transfected with its chimeric light chain cDNA (both ligated in the pBOS vector) into COS cells. Cell supernatant containing recombinant chimeric antibody is purified by Protein A Sepharose chromatography and bound antibody is eluted by addition of acid buffer. Antibodies are neutralized and dialyzed into PBS.

The purified chimeric anti-human parent mAbs are then tested for their ability to bind (by Biacore) and for functional activity, e.g., to inhibit the cytokine induced production of IgE as described in Examples 1.1.1.G and 1.1.2.B. Chimeric mAbs that maintain the activity of the parent hybridoma mAbs are selected for future development.

Example 1.2.2.2

Construction and Expression of Humanized Anti Human Parent Antibodies

Example 1.2.2.2.A

Selection of Human Antibody Frameworks

Each murine variable heavy and variable light chain gene sequence is separately aligned against 44 human immunoglobulin germline variable heavy chain or 46 germline variable light chain sequences (derived from NCBI Ig Blast website using Vector NTI software.

Humanization is based on amino acid sequence homology, CDR cluster analysis, frequency of use among expressed human antibodies, and available information on the crystal structures of human antibodies. Taking into account possible effects on antibody binding, VH-VL pairing, and other factors, murine residues are mutated to human residues where murine and human framework residues are different, with a few exceptions. Additional humanization strategies are designed based on an analysis of human germline antibody sequences, or a subgroup thereof, that possessed a high degree of homology, i.e., sequence similarity, to the actual amino acid sequence of the murine antibody variable regions.

Homology modeling is used to identify residues unique to the murine antibody sequences that are predicted to be critical to the structure of the antibody combining site, the CDRs. Homology modeling is a computational method whereby approximate three dimensional coordinates are generated for a protein. The source of initial coordinates and guidance for their further refinement is a second protein, the reference protein, for which the three dimensional coordinates are known and the sequence of which is related to the sequence of the first protein. The relationship among the sequences of the two proteins is used to generate a correspondence between the reference protein and the protein for which coordinates are desired, the target protein. The primary sequences of the reference and target proteins are aligned with coordinates of identical portions of the two proteins transferred directly from the reference protein to the target protein. Coordinates for mismatched portions of the two proteins, e.g., from residue mutations, insertions, or deletions, are constructed from generic structural templates and energy refined to insure consistency with the already transferred model coordinates. This computational protein structure may be further refined or employed directly in modeling studies. The quality of the model structure is determined by the accuracy of the contention that the reference and target proteins are related and the precision with which the sequence alignment is constructed.

For the murine mAbs, a combination of BLAST searching and visual inspection is used to identify suitable reference structures. Sequence identity of 25% between the reference and target amino acid sequences is considered the minimum necessary to attempt a homology modeling exercise. Sequence alignments are constructed manually and model coordinates are generated with the program Jackal (see Petrey, D. et al. (2003) Proteins 53 (Suppl. 6): 430-435).

The primary sequences of the murine and human framework regions of the selected antibodies share significant identity. Residue positions that differ are candidates for inclusion of the murine residue in the humanized sequence in order to retain the observed binding potency of the murine antibody. A list of framework residues that differ between the human and murine sequences is constructed manually. Table 28 shows the framework sequences chosen for this study.

TABLE 28

Sequence Of Human IgG Heavy Chain Constant Domain And Light Chain Constant Domain

| Protein | SEQ ID NO | Sequence 12345678901234567890123456789012345678901 |
|---|---|---|
| Wild type hIgG1 constant region | 95 | ASTKGPSVFPLAPSSKSTSGGTAALGCLVKDYFPEPVTVSW NSGALTSGVHTFPAVLQSSGLYSLSSVVTVPSSSLGTQTYI CNVNHKPSNTKVDKKVEPKSCDKTHTCPPCPAPELLGGPSV FLFPPKPKDTLMISRTPEVTCVVVDVSHEDPEVKFNWYVDG VEVHNAKTKPREEQYNSTYRVVSVLTVLHQDWLNGKEYKCK VSNKALPAPIEKTISKAKGQPREPQVYTLPPSREEMTKNQV SLTCLVKGFYPSDIAVEWESNGQPENNYKTTPPVLDSDGSF FLYSKLTVDKSRWQQGNVFSCSVMHEALHNHYTQKSLSLSP GK |
| Mutant hIgG1 constant region | 96 | ASTKGPSVFPLAPSSKSTSGGTAALGCLVKDYFPEPVTVSW NSGALTSGVHTFPAVLQSSGLYSLSSVVTVPSSSLGTQTYI CNVNHKPSNTKVDKKVEPKSCDKTHTCPPCPAPEAAGGPSV FLFPPKPKDTLMISRTPEVTCVVVDVSHEDPEVKFNWYVDG VEVHNAKTKPREEQYNSTYRVVSVLTVLHQDWLNGKEYKCK VSNKALPAPIEKTISKAKGQPREPQVYTLPPSREEMTKNQV SLTCLVKGFYPSDIAVEWESNGQPENNYKTTPPVLDSDGSF FLYSKLTVDKSRWQQGNVFSCSVMHEALHNHYTQKSLSLSP GK |
| Ig kappa constant region | SEQ ID NO.: 97 | TVAAPSVFIFPPSDEQLKSGTASVVCLLNNFYPREAKVQWK VDNALQSGNSQESVTEQDSKDSTYSLSSTLTLSKADYEKHK VYACEVTHQGLSSPVTKSFNRGEC |
| Ig Lambda constant region | SEQ ID NO.: 98 | QPKAAPSVTLFPPSSEELQANKATLVCLISDFYPGAVTVAW KADSSPVKAGVETTTPSKQSNNKYAASSYLSLTPEQWKSHR SYSCQVTHEGSTVEKTVAPTECS |

The likelihood that a given framework residue would impact the binding properties of the antibody depends on its proximity to the CDR residues. Therefore, using the model structures, the residues that differ between the murine and human sequences are ranked according to their distance from any atom in the CDRs. Those residues that fell within 4.5 Å of any CDR atom are identified as most important and are recommended to be candidates for retention of the murine residue in the humanized antibody (i.e., back mutation).

In silico constructed humanized antibodies are constructed using oligonucleotides. For each variable region cDNA, 6 oligonucleotides of 60-80 nucleotides each are designed to overlap each other by 20 nucleotides at the 5' and/or 3' end of each oligonucleotide. In an annealing reaction, all 6 oligonucleotides are combined, boiled, and annealed in the presence of dNTPs. DNA polymerase I, Large (Klenow) fragment (New England Biolabs #M0210, Beverley, Mass.) is added to fill-in the approximately 40 bp gaps between the overlapping oligonucleotides. PCR is performed to amplify the entire variable region gene using two outermost primers containing overhanging sequences complementary to the multiple cloning site in a modified pBOS vector (Mizushima, S, and Nagata, S. (1990) Nucleic Acids Res. 18: 17). The PCR products derived from each cDNA assembly are separated on an agarose gel and the band corresponding to the predicted variable region cDNA size is excised and purified. The variable heavy region is inserted in-frame onto a cDNA fragment encoding the human IgG1 constant region containing 2 hinge-region amino acid mutations by homologous recombination in bacteria. These mutations are a leucine to alanine change at position 234 (EU numbering) and a leucine to alanine change at position 235 (Lund et al. (1991) J. Immunol. 147:2657). The variable light chain region is inserted in-frame with the human kappa constant region by homologous recombination. Bacterial colonies are isolated and plasmid DNA extracted. cDNA inserts are sequenced in their entirety. Correct humanized heavy and light chains corresponding to each antibody are co-transfected into COS cells to transiently produce full-length humanized anti-human antibodies. Cell supernatants containing recombinant chimeric antibody are purified by Protein A Sepharose chromatography and bound antibody is eluted by addition of acid buffer. Antibodies are neutralized and dialyzed into PBS.

Example 1.2.2.3

Characterization of Humanized Antibodies

The ability of purified humanized antibodies to inhibit a functional activity is determined, e.g., using the cytokine bioassay as described in Examples 1.1.2.A. The binding affinities of the humanized antibodies to recombinant human antigen are determined using surface plasmon resonance (Biacore®) measurement as described in Example 1.1.1.B. The $IC_{50}$ values from the bioassays and the affinity of the humanized antibodies are ranked. The humanized mAbs that fully maintain the activity of the parent hybridoma mAbs are selected as candidates for future development. The top 2-3 most favorable humanized mAbs are further characterized.

Example 1.2.2.3.A

Pharmacokinetic Analysis of Humanized Antibodies

Pharmacokinetic studies are carried out in Sprague-Dawley rats and cynomolgus monkeys. Male and female rats and cynomolgus monkeys are dosed intravenously or subcutaneously with a single dose of 4 mg/kg mAb and samples are analyzed using antigen capture ELISA, and pharmacokinetic parameters are determined by noncompartmental analysis. Briefly, ELISA plates are coated with goat anti-biotin antibody (5 mg/ml, 4° C., overnight), blocked with Superblock (Pierce), and incubated with biotinylated human antigen at 50 ng/ml in 10% Superblock TTBS at room temperature for 2 hours. Serum samples are serially diluted (0.5% serum, 10% Superblock in TTBS) and incubated on the plate for 30 minutes at room temperature. Detection is carried out with HRP-labeled goat anti human antibody and concentrations are determined with the help of standard curves using the four parameter logistic fit. Values for the pharmacokinetic parameters are determined by non-compartmental model using WinNonlin software (Pharsight Corporation, Mountain View, Calif.). Humanized mAbs with good pharmacokinetics profile (T1/2 is 8-13 days or better, with low clearance and excellent bioavailability 50-100%) are selected.

Example 1.2.2.3.B

Physicochemical and In Vitro Stability Analysis of Humanized Monoclonal Antibodies Size Exclusion Chromatography Antibodies are diluted to 2.5 mg/mL with water and 20 mL is analyzed on a Shimadzu HPLC system using a TSK gel G3000 SWXL column (Tosoh Bioscience, cat# k5539-05k). Samples are eluted from the column with 211 mM sodium sulfate, 92 mM sodium phosphate, pH 7.0, at a flow rate of 0.3 mL/minutes. The HPLC system operating conditions are the following:

| | |
|---|---|
| Mobile phase: | 211 mM $Na_2SO_4$, 92 mM $Na_2HPO_4*7H_2O$, pH 7.0 |
| Gradient: | Isocratic |
| Flow rate: | 0.3 mL/minute |
| Detector wavelength: | 280 nm |
| Autosampler cooler temp: | 4° C. |
| Column oven temperature: | Ambient |
| Run time: | 50 minutes |

Table 29 contains purity data of parent antibodies and DVD-Ig constructs expressed as percent monomer (unaggregated protein of the expected molecular weight) as determined by the above protocol.

TABLE 29

Purity of Parent Antibodies and DVD-Ig Constructs as Determined by Size Exclusion Chromatography

| Parent Antibody or DVD-Ig ID | N-terminal Variable Domain (VD) | C-terminal Variable Domain (VD) | % Monomer (purity) |
|---|---|---|---|
| AB033 | | EGFR | 99.75 |
| AB004 | | HER-2 | 95.6 |
| DVD015 | EGFR | HER-2 | 96.98 |
| DVD016 | HER-2 | EGFR | 93.41 |
| AB033 | | EGFR | 99.75 |
| AB011 | | IGF1R | 98.23 |
| DVD021 | EGFR | IGF1R | 99.25 |
| DVD022 | IGF1R | EGFR | 99.53 |
| AB005 | | RON | 79.34 |
| AB033 | | EGFR | 99.75 |
| DVD024 | RON | EGFR | 96.86 |
| DVD023 | EGFR | RON | 97.27 |
| AB033 | | EGFR | 99.75 |
| AB012 | | HGF | 98.97 |
| DVD025 | EGFR | HGF | 99.21 |
| DVD026 | HGF | EGFR | 99.48 |
| AB004 | | HER-2 | 95.6 |
| AB010 | | IGF1, 2 | 93.2 |
| DVD029 | HER-2 | IGF1, 2 | 88.2 |
| DVD030 | IGF1, 2 | HER-2 | 96.9 |
| AB004 | | HER-2 | 95.6 |
| AB011 | | IGF1R | 98.23 |
| DVD031 | HER-2 | IGF1R | 94.53 |
| DVD032 | IGF1R | HER-2 | 98.1 |
| AB005 | | RON | 79.34 |
| AB012 | | HGF | 98.97 |
| DVD033 | RON | HGF | 100 |
| DVD034 | HGF | RON | 100 |
| AB014 | | VEGF | 97.81 |
| AB033 | | EGFR | 99.75 |
| DVD035 | VEGF | EGFR | 97.7 |

TABLE 29-continued

Purity of Parent Antibodies and DVD-Ig Constructs as Determined by Size Exclusion Chromatography

| Parent Antibody or DVD-Ig ID | N-terminal Variable Domain (VD) | C-terminal Variable Domain (VD) | % Monomer (purity) |
|---|---|---|---|
| DVD036 | EGFR | VEGF | 99.36 |
| AB014 | | VEGF | 97.81 |
| AB004 | | HER-2 | 95.6 |
| DVD037 | VEGF | HER-2 | 45.4 |
| DVD038 | HER-2 | VEGF | 96.9 |
| AB014 | | VEGF | 97.81 |
| AB010 | | IGF1, 2 | 93.2 |
| DVD041 | VEGF | IGF1, 2 | 94.7 |
| DVD042 | IGF1, 2 | VEGF | 92.4 |
| AB015 | | DLL-4 | 97.52 |
| AB014 | | VEGF | 97.81 |
| DVD044 | DLL4 | VEGF | 48.66 |
| DVD043 | VEGF | DLL4 | 96.72 |
| AB014 | | VEGF | 97.81 |
| AB012 | | HGF | 98.97 |
| DVD045 | VEGF | HGF | 97.88 |
| DVD046 | HGF | VEGF | 98.14 |
| AB005 | | RON | 79.34 |
| AB014 | | VEGF | 97.81 |
| DVD048 | RON | VEGF | 100 |
| DVD047 | VEGF | RON | 100 |
| AB014 | | VEGF | 97.81 |
| AB016 | | NRP1 | 93.54 |
| DVD049 | VEGF | NRP1 | 97.74 |
| DVD050 | NRP1 | VEGF | 98.59 |
| AB015 | | DLL-4 | 97.52 |
| AB047 | | P1GF | 99.47 |
| DVD257 | DLL4 | P1GF | 83.8 |
| DVD258 | P1GF | DLL4 | 100 |
| AB014 | | VEGF | 97.81 |
| AB047 | | P1GF | 99.47 |
| DVD259 | VEGF | P1GF | 90.61 |
| DVD260 | P1GF | VEGF | 98.57 |
| AB062 | | ErbB3 | 100 |
| AB033 | | EGFR | 99.75 |
| DVD299 | ErbB3 | EGFR | 98.8 |
| DVD300 | EGFR | ErbB3 | 100 |
| AB063 | | ErbB3 | 96 |
| AB033 | | EGFR | 99.75 |
| DVD305 | ErbB3 | EGFR | 83.8 |
| DVD306 | EGFR | ErbB3 | 100 |

DVD-Igs showed an excellent SEC profile with most DVD-Ig showing >90% monomer. This DVD-Ig profile is similar to that observed for parent antibodies.

SDS-PAGE

Antibodies are analyzed by sodium dodecyl sulfate-polyacrylamide gel electrophoresis (SDS-PAGE) under both reducing and non-reducing conditions. Adalimumab lot AFP04C is used as a control. For reducing conditions, the samples are mixed 1:1 with 2× tris glycine SDS-PAGE sample buffer (Invitrogen, cat# LC2676, lot#1323208) with 100 mM DTT, and heated at 60° C. for 30 minutes. For non-reducing conditions, the samples are mixed 1:1 with sample buffer and heated at 100° C. for 5 minutes. The reduced samples (10 mg per lane) are loaded on a 12% precast tris-glycine gel (Invitrogen, cat# EC6005box, lot#6111021), and the non-reduced samples (10 mg per lane) are loaded on an 8%-16% pre-cast tris-glycine gel (Invitrogen, cat# EC6045box, lot#6111021). SeeBlue Plus 2 (Invitrogen, cat#LC5925, lot#1351542) is used as a molecular weight marker. The gels are run in a XCell SureLock mini cell gel box (Invitrogen, cat# EI0001) and the proteins are separated by first applying a voltage of 75 to stack the samples in the gel, followed by a constant voltage of 125 until the dye front reached the bottom of the gel. The running buffer used is 1× tris glycine SDS buffer, prepared from a 10× tris glycine SDS buffer (ABC, MPS-79-080106)). The gels are stained overnight with colloidal blue stain (Invitrogen cat#46-7015, 46-7016) and destained with Milli-Q water until the background is clear. The stained gels are then scanned using an Epson Expression scanner (model 1680, S/N DASX003641).

Sedimentation Velocity Analysis

Antibodies are loaded into the sample chamber of each of three standard two-sector carbon epon centerpieces. These centerpieces have a 1.2 cm optical path length and are built with sapphire windows. PBS is used for a reference buffer and each chamber contained 140 µL. All samples are examined simultaneously using a 4-hole (AN-60Ti) rotor in a Beckman ProteomeLab XL-I analytical ultracentrifuge (serial # PL106C01).

Run conditions are programmed and centrifuge control is performed using ProteomeLab (v5.6). The samples and rotor are allowed to thermally equilibrate for one hour prior to analysis (20.0±0.1° C.). Confirmation of proper cell loading is performed at 3000 rpm and a single scan is recorded for each cell. The sedimentation velocity conditions are the following:

Sample Cell Volume: 420 mL
Reference Cell Volume: 420 mL
Temperature: 20° C.
Rotor Speed: 35,000 rpm
Time: 8:00 hours
UV Wavelength: 280 nm
Radial Step Size: 0.003 cm
Data Collection One data point per step without signal averaging.
Total Number of Scans: 100

LC-MS Molecular Weight Measurement of Intact Antibodies

Molecular weight of intact antibodies are analyzed by LC-MS. Each antibody is diluted to approximately 1 mg/mL with water. An 1100 HPLC (Agilent) system with a protein microtrap (Michrom Bioresources, Inc, cat#004/25109/03) is used to desalt and introduce 5 mg of the sample into an API Qstar pulsar i mass spectrometer (Applied Biosystems). A short gradient is used to elute the samples. The gradient is run with mobile phase A (0.08% FA, 0.02% TFA in HPLC water) and mobile phase B (0.08% FA and 0.02% TFA in acetonitrile) at a flow rate of 50 mL/minute. The mass spectrometer is operated at 4.5 kvolts spray voltage with a scan range from 2000 to 3500 mass to charge ratio.

LC-MS Molecular Weight Measurement of Antibody Light and Heavy Chains

Molecular weight measurement of antibody light chain (LC), heavy chain (HC) and deglycosylated HC are analyzed by LC-MS. An antibody is diluted to 1 mg/mL with water and the sample is reduced to LC and HC with a final concentration of 10 mM DTT for 30 minutes at 37° C. To deglycosylate the antibody, 100 mg of the antibody is incubated with 2 mL of PNGase F, 5 mL of 10% N-octylglucoside in a total volume of 100 mL overnight at 37° C. After deglycosylation the sample is reduced with a final concentration of 10 mM DTT for 30 minutes at 37° C. An Agilent 1100 HPLC system with a C4 column (Vydac, cat#214TP5115, S/N 060206537204069) is used to desalt and introduce the sample (5 mg) into an API Qstar pulsar i mass spectrometer (Applied Biosystems). A short gradient is used to elute the sample. The gradient is run with mobile phase A (0.08% FA, 0.02% TFA in HPLC water) and mobile phase B (0.08% FA and 0.02% TFA in acetonitrile) at a flow rate of 50 mL/minute. The mass spectrometer is operated at 4.5 kvolts spray voltage with a scan range from 800 to 3500 mass to charge ratio.

Peptide Mapping

Antibody is denatured for 15 minutes at room temperature with a final concentration of 6 M guanidine hydrochloride in 75 mM ammonium bicarbonate. The denatured samples are reduced with a final concentration of 10 mM DTT at 37° C. for 60 minutes, followed by alkylation with 50 mM iodoacetic acid (IAA) in the dark at 37° C. for 30 minutes. Following alkylation, the sample is dialyzed overnight against four liters of 10 mM ammonium bicarbonate at 4° C. The dialyzed sample is diluted to 1 mg/mL with 10 mM ammonium bicarbonate, pH 7.8 and 100 mg of antibody is either digested with trypsin (Promega, cat# V5111) or Lys-C (Roche, cat#11 047 825 001) at a 1:20 (w/w) trypsin/Lys-C:antibody ratio at 37° C. for 4 hrs. Digests are quenched with 1 mL of 1 N HCl. For peptide mapping with mass spectrometer detection, 40 mL of the digests are separated by reverse phase high performance liquid chromatography (RPHPLC) on a C18 column (Vydac, cat#218TP51, S/N NE9606 10.3.5) with an Agilent 1100 HPLC system. The peptide separation is run with a gradient using mobile phase A (0.02% TFA and 0.08% FA in HPLC grade water) and mobile phase B (0.02% TFA and 0.08% FA in acetonitrile) at a flow rate of 50 mL/minutes. The API QSTAR Pulsar i mass spectromer is operated in positive mode at 4.5 kvolts spray voltage and a scan range from 800 to 2500 mass to charge ratio.

Disulfide Bond Mapping

To denature the antibody, 100 mL of the antibody is mixed with 300 mL of 8 M guanidine HCl in 100 mM ammonium bicarbonate. The pH is checked to ensure that it is between 7 and 8 and the samples are denatured for 15 minutes at room temperature in a final concentration of 6 M guanidine HCl. A portion of the denatured sample (100 mL) is diluted to 600 mL with Milli-Q water to give a final guanidine-HCl concentration of 1 M. The sample (220 mg) is digested with either trypsin (Promega, cat #V5111, lot#22265901) or Lys-C (Roche, cat#11047825001, lot#12808000) at a 1:50 trypsin or 1:50 Lys-C: antibody (w/w) ratios (4.4 mg enzyme: 220 mg sample) at 37° C. for approximately 16 hours. An additional 5 mg of trypsin or Lys-C is added to the samples and digestion is allowed to proceed for an additional 2 hours at 37° C. Digestions are stopped by adding 1 mL of TFA to each sample. Digested samples are separated by RPHPLC using a C18 column (Vydac, cat#218TP51 S/N NE020630-4-1A) on an Agilent HPLC system. The separation is run with the same gradient used for peptide mapping using mobile phase A (0.02% TFA and 0.08% FA in HPLC grade water) and mobile phase B (0.02% TFA and 0.08% FA in acetonitrile) at a flow rate of 50 mL/minute. The HPLC operating conditions are the same as those used for peptide mapping. The API QSTAR Pulsar i mass spectromer is operated in positive mode at 4.5 kvolts spray voltage and a scan range from 800 to 2500 mass-to-charge ratio. Disulfide bonds are assigned by matching the observed MWs of peptides with the predicted MWs of tryptic or Lys-C peptides linked by disulfide bonds.

Free Sulfhydryl Determination

The method used to quantify free cysteines in an antibody is based on the reaction of Ellman's reagent, 5,5¢-dithio-bis (2-nitrobenzoic acid) (DTNB), with sulfhydryl groups (SH) which gives rise to a characteristic chromophoric product, 5-thio-(2-nitrobenzoic acid) (TNB). The reaction is illustrated in the formula:

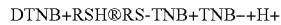

DTNB+RSH®RS-TNB+TNB-+H+

The absorbance of the TNB- is measured at 412 nm using a Cary 50 spectrophotometer. An absorbance curve is plotted using dilutions of 2 mercaptoethanol (b-ME) as the free SH standard and the concentrations of the free sulfhydryl groups in the protein are determined from absorbance at 412 nm of the sample.

The b-ME standard stock is prepared by a serial dilution of 14.2 M b-ME with HPLC grade water to a final concentration of 0.142 mM. Then standards in triplicate for each concentration are prepared. Antibody is concentrated to 10 mg/mL using an amicon ultra 10,000 MWCO centrifugal filter (Millipore, cat# UFC801096, lot# L3KN5251) and the buffer is changed to the formulation buffer used for adalimumab (5.57 mM sodium phosphate monobasic, 8.69 mM sodium phosphate dibasic, 106.69 mM NaCl, 1.07 mM sodium citrate, 6.45 mM citric acid, 66.68 mM mannitol, pH 5.2, 0.1% (w/v) Tween). The samples are mixed on a shaker at room temperature for 20 minutes. Then 180 mL of 100 mM Tris buffer, pH 8.1 is added to each sample and standard followed by the addition of 300 mL of 2 mM DTNB in 10 mM phosphate buffer, pH 8.1. After thorough mixing, the samples and standards are measured for absorption at 412 nm on a Cary 50 spectrophotometer. The standard curve is obtained by plotting the amount of free SH and $OD_{412}$ nm of the b-ME standards. Free SH content of samples are calculated based on this curve after subtraction of the blank.

Weak Cation Exchange Chromatography

Antibody is diluted to 1 mg/mL with 10 mM sodium phosphate, pH 6.0. Charge heterogeneity is analyzed using a Shimadzu HPLC system with a WCX-10 ProPac analytical column (Dionex, cat#054993, S/N 02722). The samples are loaded on the column in 80% mobile phase A (10 mM sodium phosphate, pH 6.0) and 20% mobile phase B (10 mM sodium phosphate, 500 mM NaCl, pH 6.0) and eluted at a flow rate of 1.0 mL/minute.

Oligosaccharide Profiling

Oligosaccharides released after PNGase F treatment of antibody are derivatized with 2-aminobenzamide (2-AB) labeling reagent. The fluorescent-labeled oligosaccharides are separated by normal phase high performance liquid chromatography (NPHPLC) and the different forms of oligosaccharides are characterized based on retention time comparison with known standards.

The antibody is first digested with PNGaseF to cleave N-linked oligosaccharides from the Fc portion of the heavy chain. The antibody (200 mg) is placed in a 500 mL Eppendorf tube along with 2 mL PNGase F and 3 mL of 10% N-octylglucoside. Phosphate buffered saline is added to bring the final volume to 60 mL. The sample is incubated overnight at 37° C. in an Eppendorf thermomixer set at 700 RPM. Adalimumab lot AFP04C is also digested with PNGase F as a control.

After PNGase F treatment, the samples are incubated at 95° C. for 5 minutes in an Eppendorf thermomixer set at 750 RPM to precipitate out the proteins, then the samples are placed in an Eppendorf centrifuge for 2 minutes at 10,000 RPM to spin down the precipitated proteins. The supernatant containing the oligosaccharides are transferred to a 500 mL Eppendorf tube and dried in a speed-vac at 65° C.

The oligosaccharides are labeled with 2AB using a 2AB labeling kit purchased from Prozyme (cat# GKK-404, lot#132026). The labeling reagent is prepared according to the manufacturer's instructions. Acetic acid (150 mL, provided in kit) is added to the DMSO vial (provided in kit) and mixed by pipeting the solution up and down several times. The acetic acid/DMSO mixture (100 mL) is transferred to a vial of 2-AB dye (just prior to use) and mixed until the dye is fully dissolved. The dye solution is then added to a vial of reductant (provided in kit) and mixed well (labeling reagent).

The labeling reagent (5 mL) is added to each dried oligosaccharide sample vial, and mixed thoroughly. The reaction vials are placed in an Eppendorf thermomixer set at 65° C. and 700-800 RPM for 2 hours of reaction.

After the labeling reaction, the excess fluorescent dye is removed using GlycoClean S Cartridges from Prozyme (cat# GKI-4726). Prior to adding the samples, the cartridges are washed with 1 mL of milli-Q water followed with 5 ishes of 1 mL 30% acetic acid solution. Just prior to adding the samples, 1 mL of acetonitrile (Burdick and Jackson, cat# AH015-4) is added to the cartridges.

After all of the acetonitrile passed through the cartridge, the sample is spotted onto the center of the freshly washed disc and allowed to adsorb onto the disc for 10 minutes. The disc is washed with 1 mL of acetonitrile followed by five ishes of 1 mL of 96% acetonitrile. The cartridges are placed over a 1.5 mL Eppendorf tube and the 2-AB labeled oligosaccharides are eluted with 3 ishes (400 mL each ish) of milli Q water.

The oligosaccharides are separated using a Glycosep N HPLC (cat# GKI-4728) column connected to a Shimadzu HPLC system. The Shimadzu HPLC system consisted of a system controller, degasser, binary pumps, autosampler with a sample cooler, and a fluorescent detector.

Stability at Elevated Temperatures

The buffer of antibody is either 5.57 mM sodium phosphate monobasic, 8.69 mM sodium phosphate dibasic, 106.69 mM NaCl, 1.07 mM sodium citrate, 6.45 mM citric acid, 66.68 mM mannitol, 0.1% (w/v) Tween, pH 5.2; or 10 mM histidine, 10 mM methionine, 4% mannitol, pH 5.9 using Amicon ultra centrifugal filters. The final concentration of the antibodies is adjusted to 2 mg/mL with the appropriate buffers. The antibody solutions are then filter sterized and 0.25 mL aliquots are prepared under sterile conditions. The aliquots are left at either −80° C., 5° C., 25° C., or 40° C. for 1, 2 or 3 weeks. At the end of the incubation period, the samples are analyzed by size exclusion chromatography and SDS-PAGE.

The stability samples are analyzed by SDS-PAGE under both reducing and non-reducing conditions. The procedure used is the same as described herein. The gels are stained overnight with colloidal blue stain (Invitrogen cat#46-7015, 46-7016) and destained with Milli-Q water until the background is clear. The stained gels are then scanned using an Epson Expression scanner (model 1680, S/N DASX003641). To obtain more sensitivity, the same gels are silver stained using silver staining kit (Owl Scientific) and the recommended procedures given by the manufacturer is used.

Example 1.2.2.3.C

Efficacy of a Humanized Monoclonal Antibody by Itself or in Combination with Chemotherapy on the Growth of Human Carcinoma Xenografts Human cancer cells are grown in vitro to 99% viability, 85% confluence in tissue culture flasks. SCID female or male mice (Charles Rivers Labs) at 19-25 grams, are ear tagged and shaved. Mice are then inoculated subcutaneously into the right flank with 0.2 ml of 2×10$^6$ human tumor cells (1:1 matrigel) on study day 0. Administration (IP, Q3D/week) of vehicle (PBS), humanized antibody, and/or chemotherapy is initiated after mice are size matched into separate cages of mice with mean tumor volumes of approximately 150 to 200 mm$^3$ The tumors are measured by a pair of calipers twice a week starting on approximately day 10 post inoculation and the tumor volumes calculated according to the formula V=L× W$^2$/2 (V: volume, mm$^3$; L: length, mm; W: width, m) Reduction in tumor volume is seen in animals treated with mAb alone or in combination with chemotherapy relative to tumors in animals that received only vehicle or an isotype control mAb.

Example 1.2.2.3.D

FACS Based Redirected Cytotoxicity (rCTL) Assay

Human CD3+ T cells were isolated from previously frozen isolated peripheral blood mononuclear cells (PBMC) by a negative selection enrichment column (R&D Systems, Minneapolis, Minn.; Cat.#HTCC-525). T cells were stimulated for 4 days in flasks (vent cap, Corning, Acton, Mass.) coated with 10 μg/mL anti-CD3 (OKT-3, eBioscience, Inc., San Diego, Calif.) and 2 μg/mL anti-CD28 (CD28.2, eBioscience, Inc., San Diego, Calif.) in D-PBS (Invitrogen, Carlsbad, Calif.) and cultured in 30 U/mL IL-2 (Roche) in complete RPMI 1640 media (Invitrogen, Carlsbad, Calif.) with L-glutamine, 55 mM β-ME, Pen/Strep, 10% FBS). T cells were then rested overnight in 30 U/mL IL-2 before using in assay. DoHH2 or Raji target cells were labeled with PKH26 (Sigma-Aldrich, St. Louis, Mo.) according to manufacturer's instructions. RPMI 1640 media (no phenol, Invitrogen, Carlsbad, Calif.) containing L-glutamine and 10% FBS (Hyclone, Logan, Utah) was used throughout the rCTL assay. (See Dreier et al. (2002) Int J Cancer 100:690).

Effector T cells (E) and targets (T) were plated at a final cell concentration of 10$^5$ and 10$^4$ cells/well in 96-well plates (Costar #3799, Acton, Mass.), respectively to give an E:T ratio of 10:1. DVD-Ig molecules were diluted to obtain concentration-dependent titration curves. After an overnight incubation cells are pelleted and washed with D-PBS once before resuspending in FACS buffer containing 0.1% BSA (Invitrogen, Carlsbad, Calif.), 0.1% sodium azide and 0.5 μg/mL propidium iodide (BD) in D-PBS. FACS data was collected on a FACS Canto II machine (Becton Dickinson, San Jose, Calif.) and analyzed in Flowjo (Treestar). The percent live targets in the DVD-Ig treated samples divided by the percent total targets (control, no treatment) was calculated to determine percent specific lysis. IC50s were calculated in Prism (Graphpad).

The CD3/CD 19 DVD-Ig (AB sequence IDs, AB002+AB006; Example 2.7) was tested in the redirected toxicity assay for tumor cell killing. This DVD-Ig showed in vitro tumor killing with an IC50=5.0 pM A CD3/CD20 DVD-Ig was also tested for redirected toxicity and showed in vitro tumor killing with an IC50=325 pM. The sequence of this CD3/CD20 DVD-Ig was disclosed in US Patent Application Serial No. 20070071675.

Example 1.4

Generation of a DVD-Ig

DVD-Ig molecules capable of binding two antigens are constructed using two parent monoclonal antibodies, one against human antigen A, and the other against human antigen B, selected as described herein.

Example 1.4.1

Generation of a DVD-Ig Having Two Linker Lengths

A constant region containing μl Fc with mutations at 234, and 235 to eliminate ADCC/CDC effector functions is used.

Four different anti-A/B DVD-Ig constructs are generated: 2 with short linker and 2 with long linker, each in two different domain orientations: $V_A$-$V_B$-C and $V_B$-$V_A$-C (see Table 30). The linker sequences, derived from the N-terminal sequence of human Cl/Ck or CH1 domain, are as follows:

For DVDAB constructs:
light chain (if anti-A has λ): Short linker: QPKAAP; Long linker: QPKAAPSVTLFPP
light chain (if anti-A has κ): Short linker: TVAAP; Long linker: TVAAPSVFIFPP
heavy chain (γ1): Short linker: ASTKGP; Long linker: ASTKGPSVFPLAP For DVDBA constructs:
light chain (if anti-B has λ): Short linker: QPKAAP; Long linker: QPKAAPSVTLFPP
light chain (if anti-B has k): Short linker: TVAAP; Long linker: TVAAPSVFIFPP
heavy chain (γ1): Short linker: ASTKGP; Long linker: ASTKGPSVFPLAP Heavy and light chain constructs are subcloned into the pBOS expression vector, and expressed in COS cells, followed by purification by Protein A chromatography. The purified materials are subjected to SDS-PAGE and SEC analysis.

Table 30 describes the heavy chain and light chain constructs used to express each anti-A/B DVD-Ig protein.

TABLE 30

Anti-A/B DVD-Ig Constructs

| DVD-Ig protein | Heavy chain construct | Light chain construct |
| --- | --- | --- |
| DVDABSL | DVDABHC-SL | DVDABLC-SL |
| DVDABLL | DVDABHC-LL | DVDABLC-LL |
| DVDBASL | DVDBAHC-SL | DVDBALC-SL |
| DVDBALL | DVDBAHC-LL | DVDBALC-LL |

Example 1.4.2

Molecular Cloning of DNA Constructs for DVDABSL and DVDABLL

To generate heavy chain constructs DVDABHC-LL and DVDABHC-SL, VH domain of A antibody is PCR amplified using specific primers (3' primers contain short/long liner sequence for SL/LL constructs, respectively); meanwhile VH domain of B antibody is amplified using specific primers (5' primers contains short/long liner sequence for SL/LL constructs, respectively). Both PCR reactions are performed according to standard PCR techniques and procedures. The two PCR products are gel-purified, and used together as overlapping template for the subsequent overlapping PCR reaction. The overlapping PCR products are subcloned into Srf I and Sal I double digested pBOS-hCγ1,z non-a mammalian expression vector (Abbott) by using standard homologous recombination approach.

To generate light chain constructs DVDABLC-LL and DVDABLC-SL, VL domain of A antibody is PCR amplified using specific primers (3' primers contain short/long liner sequence for SL/LL constructs, respectively); meanwhile VL domain of B antibody is amplified using specific primers (5' primers contains short/long liner sequence for SL/LL constructs, respectively). Both PCR reactions are performed according to standard PCR techniques and procedures. The two PCR products are gel-purified, and used together as overlapping template for the subsequent overlapping PCR reaction using standard PCR conditions. The overlapping PCR products are subcloned into Srf I and Not I double digested pBOS-hCk mammalian expression vector (Abbott) by using standard homologous recombination approach. Similar approach has been used to generate DVDBASL and DVDBALL as described below:

Example 1.4.3

Molecular Cloning of DNA Constructs for DVDBASL and DVDBALL

To generate heavy chain constructs DVDBAHC-LL and DVDBAHC-SL, VH domain of antibody B is PCR amplified using specific primers (3' primers contain short/long liner sequence for SL/LL constructs, respectively); meanwhile VH domain of antibody A is amplified using specific primers (5' primers contains short/long liner sequence for SL/LL constructs, respectively). Both PCR reactions are performed according to standard PCR techniques and procedures. The two PCR products are gel-purified, and used together as overlapping template for the subsequent overlapping PCR reaction using standard PCR conditions. The overlapping PCR products are subcloned into Srf I and Sal I double digested pBOS-hCγ1,z non-a mammalian expression vector (Abbott) by using standard homologous recombination approach.

To generate light chain constructs DVDBALC-LL and DVDBALC-SL, VL domain of antibody B is PCR amplified using specific primers (3' primers contain short/long liner sequence for SL/LL constructs, respectively); meanwhile VL domain of antibody A is amplified using specific primers (5' primers contains short/long liner sequence for SL/LL constructs, respectively). Both PCR reactions are performed according to standard PCR techniques and procedures. The two PCR products are gel-purified, and used together as overlapping template for the subsequent overlapping PCR reaction using standard PCR conditions. The overlapping PCR products are subcloned into Srf I and Not I double digested pBOS-hCk mammalian expression vector (Abbott) by using standard homologous recombination approach.

Example 1.4.4

Construction and Expression of Additional DVD-Ig

Example 1.4.4.1

Preparation of DVD-Ig Vector Constructs

Parent antibody amino acid sequences for specific antibodies, which recognize specific antigens or epitopes thereof, for incorporation into a DVD-Ig can be obtained by preparation of hybridomas as described above or can be obtained by sequencing known antibody proteins or nucleic acids. In addition, known sequences can be obtained from the literature. The sequences can be used to synthesize nucleic acids using standard DNA synthesis or amplification technologies and assembling the desired antibody fragments into expression vectors, using standard recombinant DNA technology, for expression in cells.

For example, nucleic acid codons were determined from amino acids sequences and oligonucleotide DNA was synthesized by Blue Heron Biotechnology, Inc., Bothell, Wash. USA. The oligonucleotides were assembled into 300-2,000 base pair double-stranded DNA fragments, cloned into a plasmid vector and sequence-verified. Cloned fragments were assembled using an enzymatic process to yield the complete gene and subcloned into an expression vector. (See U.S. Pat. Nos. 7,306,914; 7,297,541; 7,279,159; 7,150,969; and U.S. Patent Application Publication Nos. 20080115243; 20080102475; 20080081379; 20080075690; 20080063780; 20080050506; 20080038777; 20080022422; 20070289033; 20070287170; 20070254338; 20070243194; 20070225227; 20070207171; 20070150976; 20070135620; 20070128190; 20070104722; 20070092484; 20070037196; 20070028321; 20060172404; 20060162026; 20060153791; 20030215458; 20030157643).

A group of pHybE vectors (U.S. Patent Application Ser. No. 61/021,282) were used for parental antibody and DVD-Ig cloning. V1, derived from pJP183; pHybE-hCg1,z,non-a V2, was used for cloning of antibody and DVD heavy chains with a wildtype constant region. V2, derived from pJP191; pHybE-hCk V2, was used for cloning of antibody and DVD light chains with a kappa constant region. V3, derived from pJP192; pHybE-hCl V2, was used for cloning of antibody and DVDs light chains with a lambda constant region. V4, built with a lambda signal peptide and a kappa constant region, was used for cloning of DVD light chains with a lambda-kappa hybrid V domain. V5, built with a kappa signal peptide and a lambda constant region, was used for cloning of DVD light chains with a kappa-lambda hybrid V domain. V7, derived from pJP183; pHybE-hCg1,z,non-a V2, was used for cloning of antibody and DVD heavy chains with a (234,235 AA) mutant constant region.

Referring to Table 31, a number of vectors were used in the cloning of the parent antibodies and DVD-Ig VH and VL chains.

TABLE 31

Vectors Used to Clone Parent Antibodies and DVD-Igs

| ID | Heavy chain vector | Light chain vector |
|---|---|---|
| AB001 | V1 | V2 |
| AB002 | V1 | V2 |
| AB003 | V1 | V2 |
| AB004 | V1 | V2 |
| AB005 | V1 | V2 |
| AB006 | V1 | V2 |
| AB007 | V1 | V3 |
| AB008 | V1 | V2 |
| AB009 | V1 | V2 |
| AB010 | V1 | V3 |
| AB011 | V1 | V2 |
| AB012 | V1 | V2 |
| AB013 | V1 | V2 |
| AB014 | V1 | V2 |
| AB015 | V1 | V2 |
| AB016 | V1 | V2 |
| AB033 | V1 | V2 |
| AB034 | V1 | V2 |
| AB035 | V1 | V2 |
| AB039 | V1 | V2 |
| AB047 | V1 | V2 |
| AB062 | V1 | V2 |
| AB063 | V1 | V2 |
| AB067 | V7 | V3 |
| AB069 | V1 | V2 |
| AB070 | V1 | V2 |
| AB071 | V7 | V2 |
| AB072 | V1 | V2 |
| AB073 | V1 | V3 |
| AB074 | V1 | V2 |
| AB075 | V1 | V3 |
| AB077 | V1 | V2 |
| AB079 | V1 | V2 |
| AB080 | V1 | V2 |
| DVD001 | V1 | V2 |

TABLE 31-continued

Vectors Used to Clone Parent Antibodies and DVD-Igs

| ID | Heavy chain vector | Light chain vector |
|---|---|---|
| DVD002 | V1 | V2 |
| DVD003 | V1 | V2 |
| DVD004 | V1 | V2 |
| DVD005 | V1 | V5 |
| DVD006 | V1 | V4 |
| DVD007 | V1 | V2 |
| DVD008 | V1 | V2 |
| DVD009 | V1 | V2 |
| DVD010 | V1 | V2 |
| DVD011 | V1 | V2 |
| DVD012 | V1 | V2 |
| DVD013 | V1 | V2 |
| DVD014 | V1 | V2 |
| DVD015 | V1 | V2 |
| DVD016 | V1 | V2 |
| DVD017 | V1 | V2 |
| DVD018 | V1 | V2 |
| DVD019 | V1 | V5 |
| DVD020 | V1 | V4 |
| DVD021 | V1 | V2 |
| DVD022 | V1 | V2 |
| DVD023 | V1 | V2 |
| DVD024 | V1 | V2 |
| DVD025 | V1 | V2 |
| DVD026 | V1 | V2 |
| DVD027 | V1 | V2 |
| DVD028 | V1 | V2 |
| DVD029 | V1 | V5 |
| DVD030 | V1 | V4 |
| DVD031 | V1 | V2 |
| DVD032 | V1 | V2 |
| DVD033 | V1 | V2 |
| DVD034 | V1 | V2 |
| DVD035 | V1 | V2 |
| DVD036 | V1 | V2 |
| DVD037 | V1 | V2 |
| DVD038 | V1 | V2 |
| DVD039 | V1 | V2 |
| DVD040 | V1 | V2 |
| DVD041 | V1 | V5 |
| DVD042 | V1 | V4 |
| DVD043 | V1 | V2 |
| DVD044 | V1 | V2 |
| DVD045 | V1 | V2 |
| DVD046 | V1 | V2 |
| DVD047 | V1 | V2 |
| DVD048 | V1 | V2 |
| DVD049 | V1 | V2 |
| DVD050 | V1 | V2 |
| DVD073 | V1 | V2 |
| DVD074 | V1 | V2 |
| DVD075 | V1 | V2 |
| DVD076 | V1 | V2 |
| DVD077 | V1 | V2 |
| DVD078 | V1 | V2 |
| DVD079 | V1 | V2 |
| DVD080 | V1 | V2 |
| DVD081 | V1 | V2 |
| DVD082 | V1 | V2 |
| DVD083 | V1 | V2 |
| DVD084 | V1 | V2 |
| DVD085 | V1 | V2 |
| DVD086 | V1 | V2 |
| DVD087 | V1 | V2 |
| DVD088 | V1 | V2 |
| DVD089 | V1 | V2 |
| DVD090 | V1 | V2 |
| DVD091 | V1 | V2 |
| DVD092 | V1 | V2 |
| DVD093 | V1 | V2 |
| DVD094 | V1 | V2 |
| DVD107 | V1 | V2 |
| DVD108 | V1 | V2 |
| DVD131 | V1 | V2 |

TABLE 31-continued

Vectors Used to Clone Parent Antibodies and DVD-Igs

| ID | Heavy chain vector | Light chain vector |
| --- | --- | --- |
| DVD132 | V1 | V2 |
| DVD135 | V1 | V2 |
| DVD136 | V1 | V2 |
| DVD137 | V1 | V2 |
| DVD138 | V1 | V2 |
| DVD139 | V1 | V2 |
| DVD140 | V1 | V2 |
| DVD141 | V1 | V2 |
| DVD142 | V1 | V2 |
| DVD143 | V1 | V2 |
| DVD144 | V1 | V2 |
| DVD257 | V1 | V2 |
| DVD258 | V1 | V2 |
| DVD259 | V1 | V2 |
| DVD260 | V1 | V2 |
| DVD299 | V1 | V2 |
| DVD300 | V1 | V2 |
| DVD301 | V1 | V2 |
| DVD302 | V1 | V2 |
| DVD303 | V1 | V2 |
| DVD304 | V1 | V2 |
| DVD305 | V1 | V2 |
| DVD306 | V1 | V2 |
| DVD307 | V1 | V2 |
| DVD308 | V1 | V2 |
| DVD309 | V1 | V2 |
| DVD310 | V1 | V2 |
| DVD385 | V1 | V2 |
| DVD386 | V1 | V2 |
| DVD387 | V7 | V2 |
| DVD388 | V1 | V2 |
| DVD389 | V1 | V2 |
| DVD390 | V1 | V2 |
| DVD391 | V7 | V2 |
| DVD392 | V1 | V2 |
| DVD393 | V1 | V2 |
| DVD394 | V1 | V2 |
| DVD395 | V1 | V2 |
| DVD396 | V1 | V2 |
| DVD397 | V1 | V2 |
| DVD398 | V1 | V2 |
| DVD399 | V1 | V2 |
| DVD400 | V1 | V2 |
| DVD401 | V1 | V2 |
| DVD402 | V1 | V2 |
| DVD403 | V1 | V2 |
| DVD404 | V1 | V2 |
| DVD405 | V1 | V2 |
| DVD406 | V1 | V2 |
| DVD407 | V1 | V2 |
| DVD408 | V1 | V2 |
| DVD409 | V1 | V4 |
| DVD410 | V1 | V5 |
| DVD411 | V1 | V4 |
| DVD412 | V1 | V5 |
| DVD413 | V1 | V4 |
| DVD414 | V7 | V5 |
| DVD415 | V1 | V4 |
| DVD416 | V1 | V5 |
| DVD417 | V1 | V4 |
| DVD418 | V7 | V5 |
| DVD419 | V1 | V4 |
| DVD420 | V1 | V5 |
| DVD421 | V1 | V4 |
| DVD422 | V1 | V5 |
| DVD423 | V1 | V4 |
| DVD424 | V1 | V5 |
| DVD441 | V1 | V2 |
| DVD442 | V1 | V2 |
| DVD443 | V1 | V2 |
| DVD444 | V1 | V2 |
| DVD445 | V1 | V2 |
| DVD446 | V1 | V2 |
| DVD447 | V1 | V2 |
| DVD448 | V1 | V2 |
| DVD449 | V1 | V2 |
| DVD450 | V1 | V2 |
| DVD451 | V7 | V2 |
| DVD452 | V7 | V2 |
| DVD453 | V1 | V2 |
| DVD454 | V1 | V2 |
| DVD455 | V1 | V2 |
| DVD456 | V1 | V2 |
| DVD457 | V7 | V2 |
| DVD458 | V7 | V2 |
| DVD459 | V1 | V2 |
| DVD460 | V1 | V2 |
| DVD461 | V1 | V2 |
| DVD462 | V1 | V2 |
| DVD463 | V1 | V2 |
| DVD464 | V1 | V2 |
| DVD465 | V1 | V2 |
| DVD466 | V1 | V2 |
| DVD467 | V1 | V2 |
| DVD468 | V1 | V2 |
| DVD469 | V1 | V2 |
| DVD470 | V1 | V2 |
| DVD471 | V7 | V2 |
| DVD472 | V1 | V2 |
| DVD473 | V1 | V2 |
| DVD474 | V1 | V2 |
| DVD475 | V1 | V2 |
| DVD476 | V1 | V2 |
| DVD477 | V7 | V2 |
| DVD478 | V1 | V2 |
| DVD479 | V1 | V2 |
| DVD480 | V1 | V2 |
| DVD481 | V1 | V2 |
| DVD482 | V1 | V2 |
| DVD483 | V1 | V2 |
| DVD484 | V1 | V2 |
| DVD485 | V1 | V2 |
| DVD486 | V1 | V2 |
| DVD487 | V1 | V2 |
| DVD488 | V1 | V2 |
| DVD489 | V7 | V2 |
| DVD490 | V1 | V2 |
| DVD491 | V1 | V2 |
| DVD492 | V1 | V2 |
| DVD493 | V1 | V2 |
| DVD494 | V1 | V2 |
| DVD495 | V1 | V2 |
| DVD496 | V1 | V2 |
| DVD497 | V1 | V2 |
| DVD498 | V1 | V2 |
| DVD499 | V1 | V2 |
| DVD500 | V1 | V2 |
| DVD501 | V1 | V2 |
| DVD502 | V1 | V2 |
| DVD503 | V1 | V2 |
| DVD504 | V1 | V2 |
| DVD505 | V1 | V2 |
| DVD506 | V1 | V2 |
| DVD507 | V7 | V2 |
| DVD508 | V1 | V2 |
| DVD509 | V1 | V2 |
| DVD510 | V1 | V2 |
| DVD511 | V1 | V4 |
| DVD512 | V7 | V5 |
| DVD513 | V1 | V4 |
| DVD514 | V1 | V5 |
| DVD515 | V1 | V4 |
| DVD516 | V1 | V5 |
| DVD517 | V1 | V4 |
| DVD518 | V1 | V5 |
| DVD519 | V1 | V4 |
| DVD520 | V1 | V5 |
| DVD521 | V7 | V4 |

TABLE 31-continued

Vectors Used to Clone Parent Antibodies and DVD-Igs

| ID | Heavy chain vector | Light chain vector |
|---|---|---|
| DVD522 | V7 | V5 |
| DVD523 | V1 | V4 |
| DVD524 | V1 | V5 |
| DVD525 | V1 | V4 |
| DVD526 | V1 | V5 |
| DVD527 | V1 | V4 |
| DVD528 | V1 | V5 |
| DVD529 | V1 | V4 |
| DVD530 | V7 | V5 |
| DVD531 | V1 | V4 |
| DVD532 | V1 | V5 |
| DVD533 | V7 | V4 |
| DVD534 | V7 | V5 |
| DVD535 | V1 | V2 |
| DVD536 | V1 | V2 |
| DVD537 | V1 | V2 |
| DVD538 | V1 | V2 |
| DVD539 | V1 | V2 |
| DVD540 | V1 | V2 |
| DVD541 | V1 | V2 |
| DVD542 | V1 | V2 |
| DVD543 | V1 | V2 |
| DVD544 | V1 | V2 |
| DVD545 | V1 | V2 |
| DVD546 | V1 | V2 |
| DVD547 | V1 | V2 |
| DVD548 | V1 | V2 |
| DVD549 | V1 | V2 |
| DVD550 | V1 | V2 |
| DVD551 | V1 | V2 |
| DVD552 | V1 | V2 |
| DVD553 | V1 | V2 |
| DVD554 | V1 | V2 |
| DVD555 | V1 | V2 |
| DVD556 | V1 | V2 |
| DVD557 | V1 | V2 |
| DVD558 | V1 | V2 |
| DVD559 | V1 | V2 |
| DVD560 | V1 | V2 |
| DVD561 | V1 | V2 |
| DVD562 | V1 | V2 |
| DVD563 | V1 | V2 |
| DVD564 | V1 | V2 |
| DVD565 | V1 | V2 |
| DVD566 | V1 | V2 |
| DVD567 | V1 | V2 |
| DVD568 | V1 | V2 |
| DVD569 | V1 | V2 |
| DVD570 | V1 | V2 |
| DVD571 | V1 | V2 |
| DVD572 | V1 | V2 |
| DVD573 | V1 | V2 |
| DVD574 | V1 | V2 |
| DVD575 | V1 | V2 |
| DVD576 | V1 | V2 |
| DVD577 | V1 | V2 |
| DVD578 | V1 | V2 |
| DVD579 | V1 | V2 |
| DVD580 | V1 | V2 |
| DVD581 | V1 | V2 |
| DVD582 | V1 | V2 |
| DVD583 | V1 | V2 |
| DVD584 | V1 | V2 |
| DVD585 | V1 | V2 |
| DVD586 | V1 | V2 |
| DVD587 | V1 | V2 |
| DVD588 | V1 | V2 |
| DVD589 | V1 | V2 |
| DVD590 | V1 | V2 |
| DVD591 | V1 | V2 |
| DVD592 | V1 | V2 |
| DVD593 | V1 | V2 |
| DVD594 | V1 | V2 |
| DVD595 | V1 | V2 |
| DVD596 | V1 | V2 |
| DVD597 | V1 | V2 |
| DVD598 | V1 | V2 |
| DVD599 | V1 | V2 |
| DVD600 | V1 | V2 |
| DVD601 | V1 | V2 |
| DVD602 | V1 | V2 |
| DVD603 | V1 | V4 |
| DVD604 | V1 | V5 |
| DVD605 | V1 | V4 |
| DVD606 | V1 | V5 |
| DVD607 | V1 | V4 |
| DVD608 | V1 | V5 |
| DVD609 | V1 | V4 |
| DVD610 | V1 | V5 |
| DVD611 | V1 | V2 |
| DVD612 | V1 | V2 |
| DVD613 | V1 | V2 |
| DVD614 | V1 | V2 |
| DVD615 | V1 | V2 |
| DVD616 | V1 | V2 |
| DVD625 | V1 | V2 |
| DVD626 | V1 | V2 |
| DVD627 | V1 | V2 |
| DVD628 | V1 | V2 |
| DVD629 | V1 | V2 |
| DVD630 | V1 | V2 |
| DVD631 | V1 | V2 |
| DVD632 | V1 | V2 |
| DVD641 | V1 | V2 |
| DVD642 | V1 | V2 |
| DVD643 | V1 | V2 |
| DVD644 | V1 | V2 |
| DVD645 | V1 | V2 |
| DVD646 | V1 | V2 |
| DVD647 | V1 | V2 |
| DVD648 | V1 | V2 |
| DVD649 | V1 | V2 |
| DVD650 | V1 | V2 |
| DVD651 | V1 | V2 |
| DVD652 | V1 | V2 |
| DVD653 | V1 | V2 |
| DVD654 | V1 | V2 |
| DVD655 | V1 | V2 |
| DVD656 | V1 | V2 |
| DVD657 | V1 | V2 |
| DVD658 | V1 | V2 |
| DVD659 | V1 | V2 |
| DVD660 | V1 | V2 |
| DVD661 | V1 | V2 |
| DVD662 | V1 | V2 |
| DVD663 | V1 | V2 |
| DVD664 | V1 | V2 |
| DVD665 | V1 | V2 |
| DVD666 | V1 | V2 |
| DVD667 | V1 | V2 |
| DVD668 | V1 | V2 |
| DVD669 | V1 | V2 |
| DVD670 | V1 | V2 |
| DVD671 | V1 | V2 |
| DVD672 | V1 | V2 |
| DVD673 | V1 | V2 |
| DVD674 | V1 | V2 |
| DVD675 | V1 | V2 |
| DVD676 | V1 | V2 |
| DVD677 | V1 | V2 |
| DVD678 | V1 | V2 |
| DVD679 | V1 | V2 |
| DVD680 | V1 | V2 |
| DVD681 | V1 | V2 |
| DVD682 | V1 | V2 |
| DVD683 | V1 | V2 |
| DVD684 | V1 | V2 |
| DVD685 | V1 | V2 |

TABLE 31-continued

Vectors Used to Clone Parent Antibodies and DVD-Igs

| ID | Heavy chain vector | Light chain vector |
|---|---|---|
| DVD686 | V1 | V2 |
| DVD687 | V1 | V2 |
| DVD688 | V1 | V2 |
| DVD689 | V1 | V2 |
| DVD690 | V1 | V2 |
| DVD691 | V1 | V2 |
| DVD692 | V1 | V2 |
| DVD693 | V1 | V2 |
| DVD694 | V1 | V2 |
| DVD709 | V1 | V2 |
| DVD710 | V1 | V2 |
| DVD711 | V1 | V2 |
| DVD712 | V1 | V2 |

Example 1.4.4.2

Transfection and Expression in 293 Cells

The DVD-Ig vector constructs are transfected into 293 cells for production of DVD-Ig protein. The 293 transient transfection procedure used is a modification of the methods published in Durocher et al. (2002) Nucleic Acids Res. 30(2): E9 and Pham et al. (2005) Biotech. Bioengineering 90(3): 332-44. Reagents that were used in the transfection included:
- HEK 293-6E cells (human embryonic kidney cell line stably expressing EBNA1; obtained from National Research Council Canada) cultured in disposable Erlenmeyer flasks in a humidified incubator set at 130 rpm, 37° C. and 5% $CO_2$.
- Culture medium: FreeStyle 293 Expression Medium (Invitrogen 12338-018) plus 25 μg/mL Geneticin (G418) (Invitrogen 10131-027) and 0.1% Pluronic F-68 (Invitrogen 24040-032).
- Transfection medium: FreeStyle 293 Expression Medium plus 10 mM HEPES (Invitrogen 15630-080).
- Polyethylenimine (PEI) stock: 1 mg/mL sterile stock solution, pH 7.0, prepared with linear 25 kDa PEI (Polysciences) and stored at less than −15° C.
- Tryptone Feed Medium: 5% w/v sterile stock of Tryptone N1 (Organotechnie, 19554) in FreeStyle 293 Expression Medium.

Cell preparation for transfection: Approximately 2-4 hours prior to transfection, HEK 293-6E cells are harvested by centrifugation and resuspended in culture medium at a cell density of approximately 1 million viable cells per mL. For each transfection, 40 mL of the cell suspension is transferred into a disposable 250-mL Erlenmeyer flask and incubated for 2-4 hours.

Transfection: The transfection medium and PEI stock are prewarmed to room temperature (RT). For each transfection, 25 μg of plasmid DNA and 50 μg of polyethylenimine (PEI) are combined in 5 mL of transfection medium and incubated for 15±20 minutes at RT to allow the DNA:PEI complexes to form. For the BR3-Ig transfections, 25 μg of BR3-Ig plasmid is used per transfection. Each 5-mL DNA:PEI complex mixture is added to a 40-mL culture prepared previously and returned to the humidified incubator set at 130 rpm, 37° C. and 5% $CO_2$. After 20-28 hours, 5 mL of Tryptone Feed Medium is added to each transfection and the cultures are continued for six days.

Table 32 contains the yield data for parent antibodies or DVD-Ig constructs expressed as milligrams per liter in 293 cells.

TABLE 32

Transient Expression in Yields of Parent Antibodies and DVD-Ig Constructs in 293 Cells

| Parent Antibody or DVD-Ig ID | N-terminal Variable Domain (VD) | C-terminal Variable Domain (VD) | Expression Yield (mg/L) |
|---|---|---|---|
| AB006 |  | CD-19 | 9.4 |
| AB001 |  | CD-20 | 90.2 |
| DVD001 | CD-20 | CD-19 | 5.8 |
| DVD002 | CD-19 | CD-20 | 2.4 |
| AB001 |  | CD-20 | 90.2 |
| AB002 |  | CD-3 | 67.2 |
| DVD003 | CD-20 | CD-3 | 4.2 |
| DVD004 | CD-3 | CD-20 | 7.4 |
| AB007 |  | CD-80 | 9.6 |
| AB001 |  | CD-20 | 90.2 |
| DVD005 | CD-20 | CD-80 | 35.4 |
| DVD006 | CD-80 | CD-20 | 43.4 |
| AB008 |  | CD-22 | 50 |
| AB001 |  | CD-20 | 90.2 |
| DVD007 | CD-20 | CD-22 | 0.8 |
| DVD008 | CD-22 | CD-20 | 0.22 |
| AB009 |  | CD-40 | 36.6 |
| AB001 |  | CD-20 | 90.2 |
| DVD009 | CD-20 | CD-40 | 2.6 |
| DVD010 | CD-40 | CD-20 | 8 |
| AB002 |  | CD-3 | 67.2 |
| AB004 |  | HER-2 | 108.2 |
| DVD011 | CD-3 | HER-2 | 30.6 |
| DVD012 | HER-2 | CD-3 | 74 |
| AB002 |  | CD-3 | 67.2 |
| AB006 |  | CD-19 | 9.4 |
| DVD013 | CD-3 | CD-19 | 12.4 |
| DVD014 | CD-19 | CD-3 | 7.2 |
| AB033 |  | EGFR | 44.4 |
| AB004 |  | HER-2 | 108.2 |
| DVD015 | EGFR | HER-2 | 42.2 |
| DVD016 | HER-2 | EGFR | 17 |
| AB002 |  | CD-3 | 67.2 |
| AB033 |  | EGFR | 44.4 |
| DVD017 | EGFR | CD-3 | 9.6 |
| DVD018 | CD-3 | EGFR | 4 |
| AB033 |  | EGFR | 44.4 |
| AB011 |  | IGF1R | 28.5 |
| DVD021 | EGFR | IGF1R | 10.4 |
| DVD022 | IGF1R | EGFR | 17.8 |
| AB005 |  | RON | 67.4 |
| AB033 |  | EGFR | 44.4 |
| DVD024 | RON | EGFR | 19.2 |
| DVD023 | EGFR | RON | 17.8 |
| AB033 |  | EGFR | 44.4 |
| AB012 |  | HGF | 22.8 |
| DVD025 | EGFR | HGF | 5.8 |
| DVD026 | HGF | EGFR | 2.2 |
| AB004 |  | HER-2 | 108.2 |
| AB010 |  | IGF1, 2 | 38.6 |
| DVD029 | HER-2 | IGF1, 2 | 74.4 |
| DVD030 | IGF1, 2 | HER-2 | 26.8 |
| AB004 |  | HER-2 | 108.2 |
| AB011 |  | IGF1R | 28.5 |
| DVD031 | HER-2 | IGF1R | 95 |
| DVD032 | IGF1R | HER-2 | 41.4 |
| AB005 |  | RON | 67.4 |
| AB012 |  | HGF | 22.8 |
| DVD033 | RON | HGF | 29.4 |
| DVD034 | HGF | RON | 7.8 |
| AB014 |  | VEGF | 52.4 |
| AB033 |  | EGFR | 44.4 |
| DVD035 | VEGF | EGFR | 6.4 |
| DVD036 | EGFR | VEGF | 5.4 |
| AB014 |  | VEGF | 52.4 |
| AB004 |  | HER-2 | 108.2 |
| DVD037 | VEGF | HER-2 | 43.4 |

TABLE 32-continued

Transient Expression in Yields of Parent Antibodies and DVD-Ig Constructs in 293 Cells

| Parent Antibody or DVD-Ig ID | N-terminal Variable Domain (VD) | C-terminal Variable Domain (VD) | Expression Yield (mg/L) |
|---|---|---|---|
| DVD038 | HER-2 | VEGF | 41.2 |
| AB001 | | CD-20 | 57 |
| AB014 | | VEGF | 52.4 |
| DVD039 | VEGF | CD-20 | 0.22 |
| DVD040 | CD-20 | VEGF | 0.48 |
| AB014 | | VEGF | 52.4 |
| AB010 | | IGF1, 2 | 38.6 |
| DVD041 | VEGF | IGF1, 2 | 39.4 |
| DVD042 | IGF1, 2 | VEGF | 8.8 |
| AB015 | | DLL-4 | 57.6 |
| AB014 | | VEGF | 52.4 |
| DVD044 | DLL4 | VEGF | 5.4 |
| DVD043 | VEGF | DLL4 | 17.4 |
| AB014 | | VEGF | 52.4 |
| AB012 | | HGF | 22.8 |
| DVD045 | VEGF | HGF | 4 |
| DVD046 | HGF | VEGF | 1.4 |
| AB005 | | RON | 67.4 |
| AB014 | | VEGF | 52.4 |
| DVD048 | RON | VEGF | 14 |
| DVD047 | VEGF | RON | 18 |
| AB014 | | VEGF | 52.4 |
| AB016 | | NRP1 | 114.6 |
| DVD049 | VEGF | NRP1 | 13 |
| DVD050 | NRP1 | VEGF | 27.2 |
| AB015 | | DLL-4 | 57.6 |
| AB047 | | PlGF | 23.6 |
| DVD257 | DLL4 | PlGF | 31.2 |
| DVD258 | PlGF | DLL4 | 21 |
| AB014 | | VEGF | 52.4 |
| AB047 | | PlGF | 23.6 |
| DVD259 | VEGF | PlGF | 2.2 |
| DVD260 | PlGF | VEGF | 7.8 |
| AB062 | | ErbB3 | 24.6 |
| AB033 | | EGFR | 44.4 |
| DVD299 | ErbB3 | EGFR | 4.2 |
| DVD300 | EGFR | ErbB3 | 1.6 |
| AB063 | | ErbB3 | 37.8 |
| AB033 | | EGFR | 44.4 |
| DVD305 | ErbB3 | EGFR | 5.6 |
| DVD306 | EGFR | ErbB3 | 11.2 |

All DVDs expressed well in 293 cells. DVDs could be easily purified over a protein A column. In most cases >5 mg/L purified DVD-Ig could be obtained easily from supernatants of 293 cells.

Example 1.4.5

Characterization and Lead Selection of A/B DVD-Igs

The binding affinities of anti-A/B DVD-Igs are analyzed on Biacore against both protein A and protein B. The tetravalent property of the DVD-Ig is examined by multiple binding studies on Biacore. Meanwhile, the neutralization potency of the DVD-Igs for protein A and protein B are assessed by bioassays, respectively, as described herein. The DVD-Ig molecules that best retain the affinity and potency of the original parent mAbs are selected for in-depth physicochemical and bio-analytical (rat PK) characterizations as described herein for each mAb. Based on the collection of analyses, the final lead DVD-Ig is advanced into CHO stable cell line development, and the CHO-derived material is employed in stability, pharmacokinetic and efficacy studies in cynomolgus monkey, and preformulation activities.

Example 2

Generation and Characterization of Dual Variable Domain Immunoglobulins (DVD-Ig)

Dual variable domain immunoglobulins (DVD-Ig) using parent antibodies with known amino acid sequences were generated by synthesizing polynucleotide fragments encoding DVD-Ig variable heavy and DVD-Ig variable light chain sequences and cloning the fragments into a pHybC-D2 vector according to Example 1.4.4.1. The DVD-Ig constructs were cloned into and expressed in 293 cells as described in Example 1.4.4.2. The DVD-Ig protein was purified according to standard methods. Functional characteristics were determined according to the methods described in Example 1.1.1 and 1.1.2 as indicated. DVD-Ig VH and VL chains for the DVD-Igs of the invention are provided below.

Example 2.1

Generation of CD-20 and CD-19 DVD-Igs

TABLE 33

| DVD SEQ ID NO | Variable Domain Name | Outer Variable Domain Name | Inner Variable Domain Name | Sequence 123456789012345678901234567890123456789012345 |
|---|---|---|---|---|
| 99 | DVD001H | AB001VH | AB006VH | QVQLQQPGAELVKPGASVKMSCKASGYTFTSYNMH WVKQTPGRGLEWIGAIYPGNGDTSYNQKFKGKATL TADKSSSTAYMQLSSLTSEDSAVYYCARSTYYGGD WYFNVWGAGTTVTVSAASTKGPQVQLQQSGAELVR PGSSVKISCKASGYAFSSYWMNWVKQRPGQGLEWI GQIWPGDGDTNYNGKFKGKATLTADESSSTAYMQL SSLASEDSAVYFCARRETTTVGRYYYAMDYWGQGT SVTVSS |
| 100 | DVD001L | AB001VL | AB006VL | QIVLSQSPAILSPSPGEKVTMTCRASSSVSYIHWF QQKPGSSPKPWIYATSNLASGVPVRFSGSGSGTSY SLTISRVEAEDAATYYCQQWTSNPPTFGGGTKLEI KRTVAAPDILLTQTPASLAVSLGQRATISCKASQS VDYDGDSYLNWYQQIPGQPPKLLIYDASNLVSGIP PRFSGSGSGTDFTLNIHPVEKVDAATYHCQQSTED PWTFGGGTKLEIKR |
| 101 | DVD002H | AB006VH | AB001VH | QVQLQQSGAELVRPGSSVKISCKASGYAFSSYWMN WVKQRPGQGLEWIGQIWPGDGDTNYNGKFKGKATL |

TABLE 33-continued

| DVD SEQ ID NO | Outer Variable Domain Name | Inner Variable Domain Name | Sequence 123456789012345678901234567890123 45 |
|---|---|---|---|
| | | | TADESSSTAYMQLSSLASEDSAVYFCARRETTTVG RYYYAMDYWGQGTSVTVSSASTKGPQVQLQQPGAE LVKPGASVKMSCKASGYTFTSYNMHWVKQTPGRGL EWIGAIYPGNGDTSYNQKFKGKATLTADKSSSTAY MQLSSLTSEDSAVYYCARSTYYGGDWYFNVWGAGT TVTVSA |
| 102 DVD002L | AB006VL | AB001VL | DILLTQTPASLAVSLGQRATISCKASQSVDYDGDS YLNWYQQIPGQPPKLLIYDASNLVSGIPPRFSGSG SGTDFTLNIHPVEKVDAATYHCQQSTEDPWTFGGG TKLEIKRTVAAPQIVLSQSPAILSPSPGEKVTMTC RASSSVSYIHWFQQKPGSSPKPWIYATSNLASGVP VRFSGSGSGTSYSLTISRVEAEDAATYYCQQWTSN PPTFGGGTKLEIKR |

Example 2.2

Generation of CD-20 and CD-3 (Seq. 1) DVD-Igs

TABLE 34

| DVD SEQ ID NO | Outer Variable Domain Name | Inner Variable Domain Name | Sequence 123456789012345678901234567890123 45 |
|---|---|---|---|
| 103 DVD003H | AB001VH | AB002VH | QVQLQQPGAELVKPGASVKMSCKASGYTFTSYNMH WVKQTPGRGLEWIGAIYPGNGDTSYNQKFKGKATL TADKSSSTAYMQLSSLTSEDSAVYYCARSTYYGGD WYFNVWGAGTTVTVSAASTKGPQVQLQQSGAELAR PGASVKMSCKASGYTFTRYTMHWVKQRPGQGLEWI GYINPSRGYTNYNQKFKDKATLTTDKSSSTAYMQL SSLTSEDSAVYYCARYYDDHYCLDYWGQGTTLTVSS |
| 104 DVD003L | AB001VL | AB002VL | QIVLSQSPAILSPSPGEKVTMTCRASSSVSYIHWF QQKPGSSPKPWIYATSNLASGVPVRFSGSGSGTSY SLTISRVEAEDAATYYCQQWTSNPPTFGGGTKLEI KRTVAAPQIVLTQSPAIMSASPGEKVTMTCRASSS VSYMNWYQQKSGTSPKRWIYDTSKVASGVPYRFSG SGSGTSYSLTISSMEAEDAATYYCQQWSSNPLTFG SGTKLEINR |
| 105 DVD004H | AB002VH | AB001VH | QVQLQQSGAELARPGASVKMSCKASGYTFTRYTMH WVKQRPGQGLEWIGYINPSRGYTNYNQKFKDKATL TTDKSSSTAYMQLSSLTSEDSAVYYCARYYDDHYC LDYWGQGTTLTVSSASTKGPQVQLQQPGAELVKPG ASVKMSCKASGYTFTSYNMHWVKQTPGRGLEWIGA IYPGNGDTSYNQKFKGKATLTADKSSSTAYMQLSS LTSEDSAVYYCARSTYYGGDWYFNVWGAGTTVTVSA |
| 106 DVD004L | AB002VL | AB001VL | QIVLTQSPAIMSASPGEKVTMTCRASSSVSYMNWY QQKSGTSPKRWIYDTSKVASGVPYRFSGSGSGTSY SLTISSMEAEDAATYYCQQWSSNPLTFGSGTKLEI NRTVAAPQIVLSQSPAILSPSPGEKVTMTCRASSS VSYIHWFQQKPGSSPKPWIYATSNLASGVPVRFSG SGSGTSYSLTISRVEAEDAATYYCQQWTSNPPTFG GGTKLEIKR |

Example 2.3

Generation of CD-20 and CD-80 DVD-Igs

TABLE 35

| DVD SEQ ID NO | DVD Domain Name | Outer Variable Domain Name | Inner Variable Domain Name | Sequence 1234567890123456789012345678901 2345 |
|---|---|---|---|---|
| 107 | DVD005H | AB001VH | AB007VH | QVQLQQPGAELVKPGASVKMSCKASGYTFTSYNMH WVKQTPGRGLEWIGAIYPGNGDTSYNQFKGKATL TADKSSSTAYMQLSSLTSEDSAVYYCARSTYYGGD WYFNVWGAGTTVTVSAASTKGPQVQLQESGPGLVK PSETLSLTCAVSGGSISGGYGWGWIRQPPGKGLEW IGSFYSSSGNTYYNPSLKSQVTISTDTSKNQFSLK LNSMTAADTAVYYCVRDRLFSVVGMVYNNWFDVWG PGVLVTVSS |
| 108 | DVD005L | AB001VL | AB007VL | QIVLSQSPAILSPSPGEKVTMTCRASSSVSYIHWF QQKPGSSPKPWIYATSNLASGVPVRFSGSGSGTSY SLTISRVEAEDAATYYCQQWTSNPPTFGGGTKLEI KRTVAAPESALTQPPSVSGAPGQKVTISCTGSTSN IGGYDLHWYQQLPGTAPKLLIYDINKRPSGISDRF SGSKSGTAASLAITGLQTEDEADYYCQSYDSSLNA QVFGGGTRLTVLG |
| 109 | DVD006H | AB007VH | AB001VH | QVQLQESGPGLVKPSETLSLTCAVSGGSISGGYGW GWIRQPPGKGLEWIGSFYSSSGNTYYNPSLKSQVT ISTDTSKNQFSLKLNSMTAADTAVYYCVRDRLFSV VGMVYNNWFDVWGPGVLVTVSSASTKGPQVQLQQP GAELVKPGASVKMSCKASGYTFTSYNMHWVKQTPG RGLEWIGAIYPGNGDTSYNQFKGKATLTADKSSS TAYMQLSSLTSEDSAVYYCARSTYYGGDWYFNVWG AGTTVTVSA |
| 110 | DVD006L | AB007VL | AB001VL | ESALTQPPSVSGAPGQKVTISCTGSTSNIGGYDLH WYQQLPGTAPKLLIYDINKRPSGISDRFSGSKSGT AASLAITGLQTEDEADYYCQSYDSSLNAQVFGGGT RLTVLGQPKAAPQIVLSQSPAILSPSPGEKVTMTC RASSSVSYIHWFQQKPGSSPKPWIYATSNLASGVP VRFSGSGSGTSYSLTISRVEAEDAATYYCQQWTSN PPTFGGGTKLEIKR |

Example 2.4

Generation of CD-20 and CD-22 DVD-Igs

TABLE 36

| DVD SEQ ID NO | DVD Domain Name | Outer Variable Domain Name | Inner Variable Domain Name | Sequence 1234567890123456789012345678901 2345 |
|---|---|---|---|---|
| 111 | DVD007H | AB001VH | AB008VH | QVQLQQPGAELVKPGASVKMSCKASGYTFTSYNMH WVKQTPGRGLEWIGAIYPGNGDTSYNQFKGKATL TADKSSSTAYMQLSSLTSEDSAVYYCARSTYYGGD WYFNVWGAGTTVTVSAASTKGPQVQLVQSGAEVKK PGSSVKVSCKASGYTFTSYWLHWVRQAPGQGLEWI GYINPRNDYTEYNQNFKDKATITADESTNTAYMEL SSLRSEDTAFYFCARRDITTFYWGQGTTVTVSS |
| 112 | DVD007L | AB001VL | AB008VL | QIVLSQSPAILSPSPGEKVTMTCRASSSVSYIHWF QQKPGSSPKPWIYATSNLASGVPVRFSGSGSGTSY SLTISRVEAEDAATYYCQQWTSNPPTFGGGTKLEI KRTVAAPDIQLTQSPSSLSASVGDRVTMSCKSSQS VLYSANHKNYLAWYQQKPGKAPKLLIYWASTRESG VPSRFSGSGSGTDFTFTISSLQPEDIATYYCHQYL SSWTFGGGTKLEIKR |
| 113 | DVD008H | AB008VH | AB001VH | QVQLVQSGAEVKKPGSSVKVSCKASGYTFTSYWLH WVRQAPGQGLEWIGYINPRNDYTEYNQNFKDKATI TADESTNTAYMELSSLRSEDTAFYFCARRDITTFY WGQGTTVTVSSASTKGPQVQLQQPGAELVKPGASV KMSCKASGYTFTSYNMHWVKQTPGRGLEWIGAIYP |

TABLE 36-continued

| DVD SEQ ID NO | Outer Variable Domain Name | Inner Variable Domain Name | Sequence 12345678901234567890123456789012345 |
|---|---|---|---|
| | | | GNGDTSYNQKFKGKATLTADKSSSTAYMQLSSLTS EDSAVYYCARSTYYGGDWYFNVWGAGTTVTVSA |
| 114 DVD008L | AB008VL | AB001VL | DIQLTQSPSSLSASVGDRVTMSCKSSQSVLYSANH KNYLAWYQQKPGKAPKLLIYWASTRESGVPSRFSG SGSGTDFTFTISSLQPEDIATYYCHQYLSSWTFGG GTKLEIKRTVAAPQIVLSQSPAILSPSPGEKVTMT CRASSSVSYIHWFQQKPGSSPKPWIYATSNLASGV PVRFSGSGSGTSYSLTISRVEAEDAATYYCQQWTS NPPTFGGGTKLEIKR |

Example 2.5

Generation of CD-20 and CD-40 DVD-Igs

TABLE 37

| DVD SEQ ID No. | Outer Variable Domain Name | Inner Variable Domain Name | Sequence 12345678901234567890123456789012345 |
|---|---|---|---|
| 115 DVD009H | AB001VH | AB009VH | QVQLQQPGAELVKPGASVKMSCKASGYTFTSYNMH WVKQTPGRGLEWIGAIYPGNGDTSYNQKFKGKATL TADKSSSTAYMQLSSLTSEDSAVYYCARSTYYGGD WYFNVWGAGTTVTVSAASTKGPQVQLVESGGGVVQ PGRSLRLSCAASGFTFSSYGMHWVRQAPGKGLEWV AVISYEESNRYHADSVKGRFTISRDNSKITLYLQM NSLRTEDTAVYYCARDGGIAAPGPDYWGQGTLVTV SS |
| 116 DVD009L | AB001VL | AB009VL | QIVLSQSPAILSPSPGEKVTMTCRASSSVSYIHWF QQKPGSSPKPWIYATSNLASGVPVRFSGSGSGTSY SLTISRVEAEDAATYYCQQWTSNPPTFGGGTKLEI KRTVAAPDIVMTQSPLSLTVTPGEPASISCRSSQS LLYSNGYNYLDWYLQKPGQSPQVLISLGSNRASGV PDRFSGSGSGTDFTLKISRVEAEDVGVYYCMQARQ TPFTFGPGTKVDIRR |
| 117 DVD010H | AB009VH | AB001VH | QVQLVESGGGVVQPGRSLRLSCAASGFTFSSYGMH WVRQAPGKGLEWVAVISYEESNRYHADSVKGRFTI SRDNSKITLYLQMNSLRTEDTAVYYCARDGGIAAP GPDYWGQGTLVTVSSASTKGPQVQLQQPGAELVKP GASVKMSCKASGYTFTSYNMHWVKQTPGRGLEWIG AIYPGNGDTSYNQKFKGKATLTADKSSSTAYMQLS SLTSEDSAVYYCARSTYYGGDWYFNVWGAGTTVTV SA |
| 118 DVD010L | AB009VL | AB001VL | DIVMTQSPLSLTVTPGEPASISCRSSQSLLYSNGY NYLDWYLQKPGQSPQVLISLGSNRASGVPDRFSGS GSGTDFTLKISRVEAEDVGVYYCMQARQTPFTFGP GTKVDIRRTVAAPQIVLSQSPAILSPSPGEKVTMT CRASSSVSYIHWFQQKPGSSPKPWIYATSNLASGV PVRFSGSGSGTSYSLTISRVEAEDAATYYCQQWTS NPPTFGGGTKLEIKR |

Example 2.6

Generation of CD-3 (Seq. 1) and HER-2 (Seq. 1) DVD-Igs

TABLE 38

| DVD SEQ ID NO | Domain Name | Outer Variable Domain Name | Inner Variable Domain Name | Sequence |
|---|---|---|---|---|
| 119 | DVD011H | AB002VH | AB004VH | QVQLQQSGAELARPGASVKMSCKASGYTFTRYTMH WVKQRPGQGLEWIGYINPSRGYTNYNQKFKDKATL TTDKSSSTAYMQLSSLTSEDSAVYYCARYYDDHYC LDYWGQGTTLTVSSASTKGPEVQLVESGGGLVQPG GSLRLSCAASGFNIKDTYIHWVRQAPGKGLEWVAR IYPTNGYTRYADSVKGRFTISADTSKNTAYLQMNS LRAEDTAVYYCSRWGGDGFYAMDYWGQGTLVTVSS |
| 120 | DVD011L | AB002VL | AB004VL | QIVLTQSPAIMSASPGEKVTMTCRASSSVSYMNWY QQKSGTSPKRWIYDTSKVASGVPYRFSGSGSGTSY SLTISSMEAEDAATYYCQQWSSNPLTFGSGTKLEI NRTVAAPDIQMTQSPSSLSASVGDRVTITCRASQD VNTAVAWYQQKPGKAPKLLIYSASFLYSGVPSRFS GSRSGTDFTLTISSLQPEDFATYYCQQHYTTPPTF GQGTKVEIKR |
| 121 | DVD012H | AB004VH | AB002VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPQVQLQQSGAELARP GASVKMSCKASGYTFTRYTMHWVKQRPGQGLEWIG YINPSRGYTNYNQKFKDKATLTTDKSSSTAYMQLS SLTSEDSAVYYCARYYDDHYCLDYWGQGTTLTVSS |
| 122 | DVD012L | AB004VL | AB002VL | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPQIVLTQSPAIMSASPGEKVTMTCRASS SVSYMNWYQQKSGTSPKRWIYDTSKVASGVPYRFS GSGSGTSYSLTISSMEAEDAATYYCQQWSSNPLTF GSGTKLEINR |

Example 2.7

Generation of CD-3 (Seq. 1) and CD-19 DVD-Igs

TABLE 39

| DVD SEQ ID NO | Domain Name | Outer Variable Domain Name | Inner Variable Domain Name | Sequence |
|---|---|---|---|---|
| 123 | DVD013H | AB002VH | AB006VH | QVQLQQSGAELARPGASVKMSCKASGYTFTRYTMH WVKQRPGQGLEWIGYINPSRGYTNYNQKFKDKATL TTDKSSSTAYMQLSSLTSEDSAVYYCARYYDDHYC LDYWGQGTTLTVSSASTKGPQVQLQQSGAELVRPG SSVKISCKASGYAFSSYWMNWVKQRPGQGLEWIGQ IWPGDGDTNYNGKFKGKATLTADESSSTAYMQLSS LASEDSAVYFCARRETTTVGRYYYAMDYWGQGTSV TVSS |
| 124 | DVD013L | AB002VL | AB006VL | QIVLTQSPAIMSASPGEKVTMTCRASSSVSYMNWY QQKSGTSPKRWIYDTSKVASGVPYRFSGSGSGTSY SLTISSMEAEDAATYYCQQWSSNPLTFGSGTKLEI NRTVAAPDILLTQTPASLAVSLGQRATISCKASQS VDYDGDSYLNWYQQIPGQPPKLLIYDASNLVSGIP PRFSGSGSGTDFTLNIHPVEKVDAATYHCQQSTED PWTFGGGTKLEIKR |
| 125 | DVD014H | AB006VH | AB002VH | QVQLQQSGAELVRPGSSVKISCKASGYAFSSYWMN WVKQRPGQGLEWIGQIWPGDGDTNYNGKFKGKATL TADESSSTAYMQLSSLASEDSAVYFCARRETTTVG RYYYAMDYWGQGTSVTVSSASTKGPQVQLQQSGAE |

TABLE 39-continued

| DVD SEQ ID NO | Outer Variable Domain Name | Inner Variable Domain Name | Sequence 12345678901234567890123456789012345 |
|---|---|---|---|
|  |  |  | LARPGASVKMSCKASGYTFTRYTMHWVKQRPGQGL EWIGYINPSRGYTNYNQKFKDKATLTTDKSSSTAY MQLSSLTSEDSAVYYCARYYDDHYCLDYWGQGTTL TVSS |
| 126 DVD014L | AB006VL | AB002VL | DILLTQTPASLAVSLGQRATISCKASQSVDYDGDS YLNWYQQIPGQPPKLLIYDASNLVSGIPPRFSGSG SGTDFTLNIHPVEKVDAATYHCQQSTEDPWTFGGG TKLEIKRTVAAPQIVLTQSPAIMSASPGEKVTMTC RASSSVSYMNWYQQKSGTSPKRWIYDTSKVASGVP YRFSGSGSGTSYSLTISSMEAEDAATYYCQQWSSN PLTFGSGTKLEINR |

Example 2.8

Generation of EGFR (Seq. 2) and HER-2 (Seq. 1) DVD-Igs

TABLE 40

| DVD SEQ ID NO | Outer Variable Domain Name | Inner Variable Domain Name | Sequence 12345678901234567890123456789012345 |
|---|---|---|---|
| 127 DVD015H | AB033VH | AB004VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPEVQLVESGGGLVQPG GSLRLSCAASGFNIKDTYIHWVRQAPGKGLEWVAR IYPTNGYTRYADSVKGRFTISADTSKNTAYLQMNS LRAEDTAVYYCSRWGGDGFYAMDYWGQGTLVTVSS |
| 128 DVD015L | AB033VL | AB004VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPDIQMTQSPSSLSASVGDRVTITCRASQ DVNTAVAWYQQKPGKAPKLLIYSASFLYSGVPSRF SGSRSGTDFTLTISSLQPEDFATYYCQQHYTTPPT FGQGTKVEIKR |
| 129 DVD016H | AB004VH | AB033VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPQVQLKQSGPGLVQP SQSLSITCTVSGFSLTNYGVHWVRQSPGKGLEWLG VIWSGGNTDYNTPFTSRLSINKDNSKSQVFFKMNS LQSNDTAIYYCARALTYYDYEFAYWGQGTLVTVSA |
| 130 DVD016L | AB004VL | AB033VL | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPDILLTQSPVILSVSPGERVSFSCRASQ SIGTNIHWYQQRTNGSPRLLIKYASESISGIPSRF SGSGSGTDFTLSINSVESEDIADYYCQQNNNWPTT FGAGTKLELKR |

Example 2.9

Generation of EGFR (Seq. 2) and CD-3 (Seq. 1) DVD-Igs

TABLE 41

| DVD SEQ ID NO | Outer Variable Domain Name | Inner Variable Domain Name | Sequence 123456789012345678901234567890123456 |
|---|---|---|---|
| 131 | DVD017H AB033VH | AB002VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPQVQLQQSGAELARPG ASVKMSCKASGYTFTRYTMHWVKQRPGQGLEWIGY INPSRGYTNYNQKFKDKATLTTDKSSSTAYMQLSS LTSEDSAVYYCARYYDDHYCLDYWGQGTTLTVSS |
| 132 | DVD017L VD033VL | AB002VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPQIVLTQSPAIMSASPGEKVTMTCRASS SVSYMNWYQQKSGTSPKRWIYDTSKVASGVPYRFS GSGSGTSYSLTISSMEAEDAATYYCQQWSSNPLTF GSGTKLEINR |
| 133 | DVD018H AB002VH | AB033VH | QVQLQQSGAELARPGASVKMSCKASGYTFTRYTMH WVKQRPGQGLEWIGYINPSRGYTNYNQKFKDKATL TTDKSSSTAYMQLSSLTSEDSAVYYCARYYDDHYC LDYWGQGTTLTVSSASTKGPQVQLKQSGPGLVQPS QSLSITCTVSGFSLTNYGVHWVRQSPGKGLEWLGV IWSGGNTDYNTPFTSRLSINKDNSKSQVFFKMNSL QSNDTAIYYCARALTYYDYEFAYWGQGTLVTVSA |
| 134 | DVD018L AB002VL | AB033VL | QIVLTQSPAIMSASPGEKVTMTCRASSSVSYMNWY QQKSGTSPKRWIYDTSKVASGVPYRFSGSGSGTSY SLTISSMEAEDAATYYCQQWSSNPLTFGSGTKLEI NRTVAAPDILLTQSPVILSVSPGERVSFSCRASQS IGTNIHWYQQRTNGSPRLLIKYASESISGIPSRFS GSGSGTDFTLSINSVESEDIADYYCQQNNNWPTTF GAGTKLELKR |

Example 2.10

Generation of EGFR (Seq. 2) and IGF1,2 DVD-Igs

TABLE 42

| DVD SEQ ID NO | Outer Variable Domain Name | Inner Variable Domain Name | Sequence 123456789012345678901234567890123456 |
|---|---|---|---|
| 135 | DVD019H AB033VH | AB010VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPQVQLVQSGAEVKKPG ASVKVSCKASGYTFTSYDINWVRQATGQGLEWMGW MNPNSGNTGYAQKFQGRVTMTRNTSISTAYMELSS LRSEDTAVYYCARDPYYYYYGMDVWGQGTTVTVSS |
| 136 | DVD019L AB033VL | AB010VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPQSVLTQPPSVSAAPGQKVTISCSGSSS NIENNHVSWYQQLPGTAPKLLIYDNNKRPSGIPDR FSGSKSGTSATLGITGLQTGDEADYYCETWDTSLS AGRVFGGGTKLTVLG |
| 137 | DVD020H AB010VH | AB033VH | QVQLVQSGAEVKKPGASVKVSCKASGYTFTSYDIN WVRQATGQGLEWMGWMNPNSGNTGYAQKFQGRVTM TRNTSISTAYMELSSLRSEDTAVYYCARDPYYYYY GMDVWGQGTTVTVSSASTKGPQVQLKQSGPGLVQP SQSLSITCTVSGFSLTNYGVHWVRQSPGKGLEWLG |

TABLE 42-continued

| DVD SEQ ID NO | Outer Variable Domain Name | Inner Variable Domain Name | Sequence 123456789012345678901234567890123456789012345 |
|---|---|---|---|
| | | | VIWSGGNTDYNTPFTSRLSINKDNSKSQVFFKMNS LQSNDTAIYYCARALTYYDYEFAYWGQGTLVTVSA |
| 138 DVD020L | AB010VL | AB033VL | QSVLTQPPSVSAAPGQKVTISCSGSSSNIENNHVS WYQQLPGTAPKLLIYDNNKRPSGIPDRFSGSKSGT SATLGITGLQTGDEADYYCETWDTSLSAGRVFGGG TKLTVLGQPKAAPDILLTQSPVILSVSPGERVSFS CRASQSIGTNIHWYQQRTNGSPRLLIKYASESISG IPSRFSGSGSGTDFTLSINSVESEDIADYYCQQNN NWPTTFGAGTKLELKR |

Example 2.11

Generation of EGFR (Seq. 2) and IGF1R (Seq. 1) DVD-Igs with Linker Set 1

TABLE 43

| DVD SEQ ID NO | Outer Variable Domain Name | Inner Variable Domain Name | Sequence 123456789012345678901234567890123456789012345 |
|---|---|---|---|
| 139 DVD021H | AB033VH | AB011VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPEVQLLESGGGLVQPG GSLRLSCTASGFTFSSYAMNWVRQAPGKGLEWVSA ISGSGGTTFYADSVKGRFTISRDNSRTTLYLQMNS LRAEDTAVYYCAKDLGWSDSYYYYYGMDVWGQGTT VTVSS |
| 140 DVD021L | AB033VL | AB011VL | DILLTQSPVILSVSPGERVSESCRASQSIGTNIHW YQQRTNGSPRLLIKYASESISGIPSRFSGSGSGTD FTLSINSVESEDIADYYCQQNNWPTTFGAGTKLE LKRTVAAPDIQMTQFPSSLSASVGDRVTITCRASQ GIRNDLGWYQQKPGKAPKRLIYAASRLHRGVPSRF SGSGSGTEFTLTISSLQPEDFATYYCLQHNSYPCS FGQGTKLEIKR |
| 141 DVD022H | AB011VH | AB033VH | EVQLLESGGGLVQPGGSLRLSCTASGFTFSSYAMN WVRQAPGKGLEWVSAISGSGGTTFYADSVKGRFTI SRDNSRTTLYLQMNSLRAEDTAVYYCAKDLGWSDS YYYYYGMDVWGQGTTVTVSSASTKGPQVQLKQSGP GLVQPSQSLSITCTVSGFSLTNYGVHWVRQSPGKG LEWLGVIWSGGNTDYNTPFTSRLSINKDNSKSQVF FKMNSLQSNDTAIYYCARALTYYDYEFAYWGQGTL VTVSA |
| 142 DVD022L | AB011VL | AB033VL | DIQMTQFPSSLSASVGDRVTITCRASQGIRNDLGW YQQKPGKAPKRLIYAASRLHRGVPSRFSGSGSGTE FTLTISSLQPEDFATYYCLQHNSYPCSFGQGTKLE IKRTVAAPDILLTQSPVILSVSPGERVSFSCRASQ SIGTNIHWYQQRTNGSPRLLIKYASESISGIPSRF SGSGSGTDFTLSINSVESEDIADYYCQQNNWPTT FGAGTKLELKR |

Example 2.12

Generation of EGFR (Seq. 2) and IGF1R (Seq. 1)
DVD-Igs with Linker Set 2

TABLE 44

| DVD SEQ ID NO | DVD Variable Domain Name | Outer Variable Domain Name | Inner Variable Domain Name | Sequence |
|---|---|---|---|---|
| 143 | DVD611H | AB011VH | AB033VH | EVQLLESGGGLVQPGGSLRLSCTASGFTFSSYAMN WVRQAPGKGLEWVSAISGSGGTTFYADSVKGRFTI SRDNSRTTLYLQMNSLRAEDTAVYYCAKDLGWSDS YYYYYGMDVWGQGTTVTVSSASTKGPSVFPLAPQV QLKQSGPGLVQPSQSLSITCTVSGFSLTNYGVHWV RQSPGKGLEWLGVIWSGGNTDYNTPFTSRLSINKD NSKSQVFFKMNSLQSNDTAIYYCARALTYYDYEFA YWGQGTLVTVSA |
| 144 | DVD611L | AB011VL | AB033VL | DIQMTQFPSSLSASVGDRVTITCRASQGIRNDLGW YQQKPGKAPKRLIYAASRLHRGVPSRFSGSGSGTE FTLTISSLQPEDFATYYCLQHNSYPCSFGQGTKLE IKRTVAAPSVFIFPPDILLTQSPVILSVSPGERVS FSCRASQSIGTNIHWYQQRTNGSPRLLIKYASESI SGIPSRFSGSGSGTDFTLSINSVESEDIADYYCQQ NNNWPTTFGAGTKLELKR |
| 145 | DVD612H | AB033VH | AB011VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPSVFPLAPEVQLLESG GGLVQPGGSLRLSCTASGFTFSSYAMNWVRQAPGK GLEWVSAISGSGGTTFYADSVKGRFTISRDNSRTT LYLQMNSLRAEDTAVYYCAKDLGWSDSYYYYYGMD VWGQGTTVTVSS |
| 146 | DVD612L | AB033VL | AB011VL | DILLTQSPVILSVSPGERVSFSCRASQSIGTNTHW YQQRTNGSPRLLIKYASESISGIPSRFSGSGSGTD FTLSINSVESEDIADYYCQQNNNWPTTFGAGTKLE LKRTVAAPSVFIFPPDIQMTQFPSSLSASVGDRVT ITCRASQGIRNDLGWYQQKPGKAPKRLIYAASRLH RGVPSRFSGSGSGTEFTLTISSLQPEDFATYYCLQ HNSYPCSFGQGTKLEIKR |

Example 2.13

Generation of EGFR (Seq. 2) and IGF1R (Seq. 1)
DVD-Igs with Linker Set 3

TABLE 45

| DVD SEQ ID NO | DVD Variable Domain Name | Outer Variable Domain Name | Inner Variable Domain Name | Sequence |
|---|---|---|---|---|
| 147 | DVD613H | AB011VH | AB033VH | EVQLLESGGGLVQPGGSLRLSCTASGFTFSSYAMN WVRQAPGKGLEWVSAISGSGGTTFYADSVKGRFTI SRDNSRTTLYLQMNSLRAEDTAVYYCAKDLGWSDS YYYYYGMDVWGQGTTVTVSSASTKGPSVFPLAPQV QLKQSGPGLVQPSQSLSITCTVSGFSLTNYGVHWV RQSPGKGLEWLGVIWSGGNTDYNTPFTSRLSINKD NSKSQVFFKMNSLQSNDTAIYYCARALTYYDYEFA YWGQGTLVTVSA |
| 148 | DVD613L | AB011VL | AB033VL | DIQMTQFPSSLSASVGDRVTITCRASQGIRNDLGW YQQKPGKAPKRLIYAASRLHRGVPSRFSGSGSGTE FTLTISSLQPEDFATYYCLQHNSYPCSFGQGTKLE IKRTVAAPDILLTQSPVILSVSPGERVSFSCRASQ SIGTNIHWYQQRTNGSPRLLIKYASESISGIPSRF SGSGSGTDFTLSINSVESEDIADYYCQQNNNWPTT FGAGTKLELKR |

TABLE 45-continued

| DVD SEQ ID NO | Outer Variable Domain Name | Inner Variable Domain Name | Sequence 123456789012345678901234567890 12345 |
|---|---|---|---|
| 149 DVD614H | AB033VH | AB011VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPSVFPLAPEVQLLESG GGLVQPGGSLRLSCTASGFTFSSYAMNWVRQAPGK GLEWVSAISGSGGTTFYADSVKGRFTISRDNSRTT LYLQMNSLRAEDTAVYYCAKDLGWSDSYYYYGMD VWGQGTTVTVSS |
| 150 DVD614L | AB033VL | AB011VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPDIQMTQFPSSLSASVGDRVTITCRASQ GIRNDLGWYQQKPGKAPKRLIYAASRLHRGVPSRF SGSGSGTEFTLTISSLQPEDFATYYCLQHNSYPCS FGQGTKLEIKR |

Example 2.14

Generation of EGFR (Seq. 2) and IGF1R (Seq. 1) DVD-Igs with Linker Set 4

TABLE 46

| DVD SEQ ID NO | Outer Variable Domain Name | Inner Variable Domain Name | Sequence 123456789012345678901234567890 12345 |
|---|---|---|---|
| 151 DVD615H | AB011VH | AB033VH | EVQLLESGGGLVQPGGSLRLSCTASGFTFSSYAMN WVRQAPGKGLEWVSAISGSGGTTFYADSVKGRFTI SRDNSRTTLYLQMNSLRAEDTAVYYCAKDLGWSDS YYYYGMDVWGQGTTVTVSSASTKGPQVQLKQSGP GLVQPSQSLSITCTVSGFSLTNYGVHWVRQSPGKG LEWLGVIWSGGNTDYNTPFTSRLSINKDNSKSQVF FKMNSLQSNDTAIYYCARALTYYDYEFAYWGQGTL VTVSA |
| 152 DVD615L | AB011VL | AB033VL | DIQMTQFPSSLSASVGDRVTITCRASQGIRNDLGW YQQKPGKAPKRLIYAASRLHRGVPSRFSGSGSGTE FTLTISSLQPEDFATYYCLQHNSYPCSFGQGTKLE IKRTVAAPSVFIFPPDILLTQSPVILSVSPGERVS FSCRASQSIGTNIHWYQQRTNGSPRLLIKYASESI SGIPSRFSGSGSGTDFTLSINSVESEDIADYYCQQ NNNWPTTFGAGTKLELKR |
| 153 DVD616H | AB033VH | AB011VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPEVQLLESGGGLVQPG GSLRLSCTASGFTFSSYAMNWVRQAPGKGLEWVSA ISGSGGTTFYADSVKGRFTISRDNSRTTLYLQMNS LRAEDTAVYYCAKDLGWSDSYYYYGMDVWGQGTT VTVSS |
| 154 DVD616L | AB033VL | AB011VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPSVFIFPPDIQMTQFPSSLSASVGDRVT ITCRASQGIRNDLGWYQQKPGKAPKRLIYAASRLH RGVPSRFSGSGSGTEFTLTISSLQPEDFATYYCLQ HNSYPCSFGQGTKLEIKR |

Example 2.15

Generation of EGFR (Seq. 2) and IGF1R (Seq. 2) DVD-Igs with Linker Set 1

TABLE 47

| DVD SEQ ID NO | DVD Variable Domain Name | Outer Variable Domain Name | Inner Variable Domain Name | Sequence 12345678901234567890123456789012345 |
|---|---|---|---|---|
| 155 | DVD603H | AB075VH | AB033VH | EVQLVQSGAEVKKPGSSVKVSCKASGGTFSSYAIS WVRQAPGQGLEWMGGIIPIFGTANYAQKFQGRVTI TADKSTSTAYMELSSLRSEDTAVYYCARAPLRFLE WSTQDHYYYYMDVWGKGTTVTSSASTKGPQVQL KQSGPGLVQPSQSLSITCTVSGFSLTNYGVHWVRQ SPGKGLEWLGVIWSGGNTDYNTPFTSRLSINKDNS KSQVFFKMNSLQSNDTAIYYCARALTYYDYEFAYW GQGTLVTVSA |
| 156 | DVD603L | AB075VL | AB033VL | SSELTQDPAVSVALGQTVRITCQGDSLRSYYATWY QQKPGQAPILVIYGENKRPSGIPDRFSGSSSGNTA SLTITGAQAEDEADYYCKSRDGSGQHLVFGGGTKL TVLGQPKAAPDILLTQSPVILSVSPGERVSFSCRA SQSIGTNIHWYQQRTNGSPRLLIKYASESISGIPS RFSGSGSGTDFTLSINSVESEDIADYYCQQNNNWP TTFGAGTKLELKR |
| 157 | DVD604H | AB033VH | AB075VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPEVQLVQSGAEVKKPG SSVKVSCKASGGTFSSYAISWVRQAPGQGLEWMGG IIPIFGTANYAQKFQGRVTITADKSTSTAYMELSS LRSEDTAVYYCARAPLRFLEWSTQDHYYYYMDVW GKGTTVTVSS |
| 158 | DVD604L | AB033VL | AB075VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPSSELTQDPAVSVALGQTVRITCQGDSL RSYYATWYQQKPGQAPILVIYGENKRPSGIPDRFS GSSSGNTASLTITGAQAEDEADYYCKSRDGSGQHL VFGGGTKLTVLG |

Example 2.16

Generation of EGFR (Seq. 2) and IGF1R (Seq. 2) DVD-Igs with Linker Set 2

TABLE 48

| DVD SEQ ID NO | DVD Variable Domain Name | Outer Variable Domain Name | Inner Variable Domain Name | Sequence 12345678901234567890123456789012345 |
|---|---|---|---|---|
| 159 | DVD605H | AB075VH | AB033VH | EVQLVQSGAEVKKPGSSVKVSCKASGGTFSSYAIS WVRQAPGQGLEWMGGIIPIFGTANYAQKFQGRVTI TADKSTSTAYMELSSLRSEDTAVYYCARAPLRFLE WSTQDHYYYYMDVWGKGTTVTSSASTKGPSVFP LAPQVQLKQSGPGLVQPSQSLSITCTVSGFSLTNY GVHWVRQSPGKGLEWLGVIWSGGNTDYNTPFTSRL SINKDNSKSQVFFKMNSLQSNDTAIYYCARALTYY DYEFAYWGQGTLVTVSA |
| 160 | DVD605L | AB075VL | AB033VL | SSELTQDPAVSVALGQTVRITCQGDSLRSYYATWY QQKPGQAPILVIYGENKRPSGIPDRFSGSSSGNTA SLTITGAQAEDEADYYCKSRDGSGQHLVFGGGTKL TVLGQPKAAPSVTLFPPDILLTQSPVILSVSPGER VSFSCRASQSIGTNIHWYQQRTNGSPRLLIKYASE SISGIPSRFSGSGSGTDFTLSINSVESEDIADYYC QQNNNWPTTFGAGTKLELKR |

TABLE 48-continued

| DVD SEQ ID NO | DVD Variable Domain Name | Outer Variable Domain Name | Inner Variable Domain Name | Sequence 123456789012345678901234567890123456789012345 |
|---|---|---|---|---|
| 161 | DVD606H | AB033VH | AB075VH | QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSS |
| 162 | DVD606L | AB033VL | AB075VL | DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLG |

Example 2.17

Generation of EGFR (Seq. 2) and IGF1R (Seq. 2) DVD-Igs with Linker Set 3

TABLE 49

| DVD SEQ ID NO | DVD Variable Domain Name | Outer Variable Domain Name | Inner Variable Domain Name | Sequence 123456789012345678901234567890123456789012345 |
|---|---|---|---|---|
| 163 | DVD607H | AB075VH | AB033VH | EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSSASTKGPSVFPLAPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA |
| 164 | DVD607L | AB075VL | AB033VL | SSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLGQPKAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR |
| 165 | DVD608H | AB033VH | AB075VH | QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSS |
| 166 | DVD608L | AB033VL | AB075VL | DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLG |

Example 2.18

Generation of EGFR (Seq. 2) and IGF1R (Seq. 2)
DVD-Igs with Linker Set 4

TABLE 50

| DVD SEQ ID NO | Variable Domain Name | Outer Variable Domain Name | Inner Variable Domain Name | Sequence |
|---|---|---|---|---|
| 167 | DVD609H | AB075VH | AB033VH | EVQLVQSGAEVKKPGSSVKVSCKASGGTFSSYAIS WVRQAPGQGLEWMGGIIPIFGTANYAQKFQGRVTI TADKSTSTAYMELSSLRSEDTAVYYCARAPLRFLE WSTQDHYYYYMDVWGKGTTVTVSSASTKGPQVQL KQSGPGLVQPSQSLSITCTVSGFSLTNYGVHWVRQ SPGKGLEWLGVIWSGGNTDYNTPFTSRLSINKDNS KSQVFFKMNSLQSNDTAIYYCARALTYYDYEFAYW GQGTLVTVSA |
| 168 | DVD609L | AB075VL | AB033VL | SSELTQDPAVSVALGQTVRITCQGDSLRSYYATWY QQKPGQAPILVIYGENKRPSGIPDRFSGSSSGNTA SLTITGAQAEDEADYYCKSRDGSGQHLVFGGGTKL TVLGQPKAAPSVTLFPPDILLTQSPVILSVSPGER VSFSCRASQSIGTNIHWYQQRTNGSPRLLIKYASE SISGIPSRFSGSGSGTDFTLSINSVESEDIADYYC QQNNNWPTTFGAGTKLELKR |
| 169 | DVD610H | AB033VH | AB075VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPEVQLVQSGAEVKKPG SSVKVSCKASGGTFSSYAISWVRQAPGQGLEWMGG IIPIFGTANYAQKFQGRVTITADKSTSTAYMELSS LRSEDTAVYYCARAPLRFLEWSTQDHYYYYMDVW GKGTTVTVSS |
| 170 | DVD610L | AB033VL | AB075VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPSVFIFPPSSELTQDPAVSVALGQTVRI TCQGDSLRSYYATWYQQKPGQAPILVIYGENKRPS GIPDRFSGSSSGNTASLTITGAQAEDEADYYCKSR DGSGQHLVFGGGTKLTVLG |

Example 2.19

Generation of EGFR (Seq. 2) and IGF1R (Seq. 3)
DVD-Igs with Linker Set 1

TABLE 51

| DVD SEQ ID NO | Variable Domain Name | Outer Variable Domain Name | Inner Variable Domain Name | Sequence |
|---|---|---|---|---|
| 171 | DVD625H | AB077VH | AB033VH | EVQLVQSGGGLVKPGGSLRLSCAASGFTFSSFAMH WVRQAPGKGLEWISVIDTRGATYYADSVKGRFTIS RDNAKNSLYLQMNSLRAEDTAVYYCARLGNFYYGM DVWGQGTTVTVSSASTKGPQVQLKQSGPGLVQPSQ SLSITCTVSGFSLTNYGVHWVRQSPGKGLEWLGVI WSGGNTDYNTPFTSRLSINKDNSKSQVFFKMNSLQ SNDTAIYYCARALTYYDYEFAYWGQGTLVTVSA |
| 172 | DVD625L | AB077VL | AB033VL | EIVLTQSPGTLSVSPGERATLSCRASQSIGSSLHW YQQKPGQAPRLLIKYASQSLSGIPDRFSGSGSGTD FTLTISRLEPEDFAVYYCHQSSRLPHTFGQGTKVE IKRTVAAPDILLTQSPVILSVSPGERVSFSCRASQ SIGTNIHWYQQRTNGSPRLLIKYASESISGIPSRF SGSGSGTDFTLSINSVESEDIADYYCQQNNNWPTT FGAGTKLELKR |
| 173 | DVD626H | AB033VH | AB077VH | QVQLKQSGPGLVQPSQSLSITCTVSGFSLTNYGVH WVRQSPGKGLEWLGVIWSGGNTDYNTPFTSRLSIN |

TABLE 51-continued

| DVD SEQ ID NO | Outer Variable Domain Name | Inner Variable Domain Name | Sequence 12345678901234567890123456789012345 |
|---|---|---|---|
| | | | KDNSKSQVFFKMNSLQSNDTAIYYCARALTYYDYE FAYWGQGTLVTVSAASTKGPEVQLVQSGGGLVKPG GSLRLSCAASGFTFSSFAMHWVRQAPGKGLEWISV IDTRGATYYADSVKGRFTISRDNAKNSLYLQMNSL RAEDTAVYYCARLGNFYYGMDVWGQGTTVTVSS |
| 174 | DVD626L | AB033VL | AB077VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPEIVLTQSPGTLSVSPGERATLSCRASQ SIGSSLHWYQQKPGQAPRLLIKYASQSLSGIPDRF SGSGSGTDFTLTISRLEPEDFAVYYCHQSSRLPHT FGQGTKVEIKR |

Example 2.20

Generation of EGFR (Seq. 2) and IGF1R (Seq. 3) DVD-Igs with Linker Set 2

TABLE 52

| DVD SEQ ID NO | Outer Variable Domain Name | Inner Variable Domain Name | Sequence 12345678901234567890123456789012345 |
|---|---|---|---|
| 175 | DVD627H | AB077VH | AB033VH | EVQLVQSGGGLVKPGGSLRLSCAASGFTFSSFAMH WVRQAPGKGLEWISVIDTRGATYYADSVKGRFTIS RDNAKNSLYLQMNSLRAEDTAVYYCARLGNFYYGM DVWGQGTTVTVSSASTKGPSVFPLAPQVQLKQSGP GLVQPSQSLSITCTVSGFSLTNYGVHWVRQSPGKG LEWLGVIWSGGNTDYNTPFTSRLSINKDNSKSQVF FKMNSLQSNDTAIYYCARALTYYDYEFAYWGQGTL VTVSA |
| 176 | DVD627L | AB077VL | AB033VL | EIVLTQSPGTLSVSPGERATLSCRASQSIGSSLHW YQQKPGQAPRLLIKYASQSLSGIPDRFSGSGSGTD FTLTISRLEPEDFAVYYCHQSSRLPHTFGQGTKVE IKRTVAAPSVFIFPPDILLTQSPVILSVSPGERVS FSCRASQSIGTNIHWYQQRTNGSPRLLIKYASESI SGIPSRFSGSGSGTDFTLSINSVESEDIADYYCQQ NNNWPTTFGAGTKLELKR |
| 177 | DVD628H | AB033VH | AB077VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPSVFPLAPEVQLVQSG GGLVKPGGSLRLSCAASGFTFSSFAMHWVRQAPGK GLEWISVIDTRGATYYADSVKGRFTISRDNAKNSL YLQMNSLRAEDTAVYYCARLGNFYYGMDVWGQGTT VTVSS |
| 178 | DVD628L | AB033VL | AB077VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPSVFIFPPEIVLTQSPGTLSVSPGERAT LSCRASQSIGSSLHWYQQKPGQAPRLLIKYASQSL SGIPDRFSGSGSGTDFTLTISRLEPEDFAVYYCHQ SSRLPHTFGQGTKVEIKR |

Example 2.21

Generation of EGFR (Seq. 2) and IGF1R (Seq. 3) DVD-Igs with Linker Set 3

TABLE 53

| DVD SEQ ID NO | DVD Variable Domain Name | Outer Variable Domain Name | Inner Variable Domain Name | Sequence 123456789012345678901234567890123456789012345 |
|---|---|---|---|---|
| 179 | DVD629H | AB077VH | AB033VH | EVQLVQSGGGLVKPGGSLRLSCAASGFTFSSFAMH WVRQAPGKGLEWISVIDTRGATYYADSVKGRFTIS RDNAKNSLYLQMNSLRAEDTAVYYCARLGNFYYGM DVWGQGTTVTVSSASTKGPSVFPLAPQVQLKQSGP GLVQPSQSLSITCTVSGFSLTNYGVHWVRQSPGKG LEWLGVIWSGGNTDYNTPFTSRLSINKDNSKSQVF FKMNSLQSNDTAIYYCARALTYYDYEFAYWGQGTL VTVSA |
| 180 | DVD629L | AB077VL | AB033VL | EIVLTQSPGTLSVSPGERATLSCRASQSIGSSLHW YQQKPGQAPRLLIKYASQSLSGIPDRFSGSGSGTD FTLTISRLEPEDFAVYYCHQSSRLPHTFGQGTKVE IKRTVAAPDILLTQSPVILSVSPGERVSFSCRASQ SIGTNIHWYQQRTNGSPRLLIKYASESISGIPSRF SGSGSGTDFTLSINSVESEDIADYYCQQNNNWPTT FGAGTKLELKR |
| 181 | DVD630H | AB033VH | AB077VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPSVFPLAPEVQLVQSG GGLVKPGGSLRLSCAASGFTFSSFAMHWVRQAPGK GLEWISVIDTRGATYYADSVKGRFTISRDNAKNSL YLQMNSLRAEDTAVYYCARLGNFYYGMDVWGQGTT VTVSS |
| 182 | DVD630L | AB033VL | AB077VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPEIVLTQSPGTLSVSPGERATLSCRASQ SIGSSLHWYQQKPGQAPRLLIKYASQSLSGIPDRF SGSGSGTDFTLTISRLEPEDFAVYYCHQSSRLPHT FGQGTKVEIKR |

Example 2.22

Generation of EGFR (Seq. 2) and IGF1R (Seq. 3) DVD-Igs with Linker Set 4

TABLE 54

| DVD SEQ ID NO | DVD Variable Domain Name | Outer Variable Domain Name | Inner Variable Domain Name | Sequence 123456789012345678901234567890123456789012345 |
|---|---|---|---|---|
| 183 | DVD631H | AB077VH | AB033VH | EVQLVQSGGGLVKPGGSLRLSCAASGFTFSSFAMH WVRQAPGKGLEWISVIDTRGATYYADSVKGRFTIS RDNAKNSLYLQMNSLRAEDTAVYYCARLGNFYYGM DVWGQGTTVTVSSASTKGPQVQLKQSGPGLVQPSQ SLSITCTVSGFSLTNYGVHWVRQSPGKGLEWLGVI WSGGNTDYNTPFTSRLSINKDNSKSQVFFKMNSLQ SNDTAIYYCARALTYYDYEFAYWGQGTLVTVSA |
| 184 | DVD631L | AB077VL | AB033VL | EIVLTQSPGTLSVSPGERATLSCRASQSIGSSLHW YQQKPGQAPRLLIKYASQSLSGIPDRFSGSGSGTD FTLTISRLEPEDFAVYYCHQSSRLPHTFGQGTKVE IKRTVAAPSVFIFPPDILLTQSPVILSVSPGERVS FSCRASQSIGTNIHWYQQRTNGSPRLLIKYASESI SGIPSRFSGSGSGTDFTLSINSVESEDIADYYCQQ NNNWPTTFGAGTKLELKR |
| 185 | DVD632H | AB033VH | AB077VH | QVQLKQSGPGLVQPSQSLSITCTVSGFSLTNYGVH WVRQSPGKGLEWLGVIWSGGNTDYNTPFTSRLSIN |

TABLE 54-continued

| DVD SEQ ID NO | Outer Variable Domain Name | Inner Variable Domain Name | Sequence 123456789012345678901234567890123456789012345 |
|---|---|---|---|
| | | | KDNSKSQVFFKMNSLQSNDTAIYYCARALTYYDYE FAYWGQGTLVTVSAASTKGPEVQLVQSGGGLVKPG GSLRLSCAASGFTFSSFAMHWVRQAPGKGLEWISV IDTRGATYYADSVKGRFTISRDNAKNSLYLQMNSL RAEDTAVYYCARLGNFYYGMDVWGQGTTVTVSS |
| 186 | DVD632L | AB033VL AB077VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPSVFIFPPEIVLTQSPGTLSVSPGERAT LSCRASQSIGSSLHWYQQKPGQAPRLLIKYASQSL SGIPDRFSGSGSGTDFTLTISRLEPEDFAVYYCHQ SSRLPHTFGQGTKVEIKR |

Example 2.23

Generation of EGFR (Seq. 2) and RON (Seq. 1) DVD-Igs with Linker Set 1

TABLE 55

| DVD SEQ ID NO | Outer Variable Domain Name | Inner Variable Domain Name | Sequence 123456789012345678901234567890123456789012345 |
|---|---|---|---|
| 187 | DVD023H | AB033VH AB005VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPEVQLVQSGGGLVKPG GSLRLSCAASGFTFSSYAMHWVRQAPGKGLEWVAV ISYDGSNKYYADSVKGRFTISRDNSKNTLYLQMNS LRAEDTAVYYCARFSGWPNNYYYYGMDVWGQGTTV TVSS |
| 188 | DVD023L | AB033VL AB005VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPDVVMTQSPLSLPVTPGEPASISCRSSQ SLLHSNGFNYVDWYLQKPGQSPHLLIYFGSYRASG VPDRFSGSGSGTDFTLKISRVEAEDVGVYYCMQAL QTPPWTFGQGTKVEIRR |
| 189 | DVD024H | AB005VH AB033VH | EVQLVQSGGGLVKPGGSLRLSCAASGFTFSSYAMH WVRQAPGKGLEWVAVISYDGSNKYYADSVKGRFTI SRDNSKNTLYLQMNSLRAEDTAVYYCARFSGWPNN YYYYGMDVWGQGTTVTVSSASTKGPQVQLKQSGPG LVQPSQSLSITCTVSGFSLTNYGVHWVRQSPGKGL EWLGVIWSGGNTDYNTPFTSRLSINKDNSKSQVFF KMNSLQSNDTAIYYCARALTYYDYEFAYWGQGTLV TVSA |
| 190 | DVD024L | AB005VL AB033VL | DVVMTQSPLSLPVTPGEPASISCRSSQSLLHSNGF NYVDWYLQKPGQSPHLLIYFGSYRASGVPDRFSGS GSGTDFTLKISRVEAEDVGVYYCMQALQTPPWTFG QGTKVEIRRTVAAPDILLTQSPVILSVSPGERVSF SCRASQSIGTNIHWYQQRTNGSPRLLIKYASESIS GIPSRFSGSGSGTDFTLSINSVESEDIADYYCQQN NNWPTTFGAGTKLELKR |

Example 2.24

Generation of EGFR (Seq. 2) and RON (Seq. 1)
DVD-Igs with Linker Set 2

TABLE 56

| DVD SEQ ID NO | Outer Variable Domain Name | Inner Variable Domain Name | Sequence 123456789012345678901234567890123456789012345 |
|---|---|---|---|
| 191 | DVD535H AB005VH | AB033VH | EVQLVQSGGGLVKPGGSLRLSCAASGFTFSSYAMH WVRQAPGKGLEWVAVISYDGSNKYYADSVKGRFTI SRDNSKNTLYLQMNSLRAEDTAVYYCARFSGWPNN YYYYGMDVWGQGTTVTVSSASTKGPSVFPLAPQVQ LKQSGPGLVQPSQSLSITCTVSGFSLTNYGVHWVR QSPGKGLEWLGVIWSGGNTDYNTPFTSRLSINKDN SKSQVFFKMNSLQSNDTAIYYCARALTYYDYEFAY WGQGTLVTVSA |
| 192 | DVD535L AB005VL | AB033VL | DVVMTQSPLSLPVTPGEPASISCRSSQSLLHSNGF NYVDWYLQKPGQSPHLLIYFGSYRASGVPDRFSGS GSGTDFTLKISRVEAEDVGVYYCMQALQTPPWTFG QGTKVEIRRTVAAPSVFIFPPDILLTQSPVILSVS PGERVSFSCRASQSIGTNIHWYQQRTNGSPRLLIK YASESISGIPSRFSGSGSGTDFTLSINSVESEDIA DYYCQQNNNWPTTFGAGTKLELKR |
| 193 | DVD536H AB033VH | AB005VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPSVFPLAPEVQLVQSG GGLVKPGGSLRLSCAASGFTFSSYAMHWVRQAPGK GLEWVAVISYDGSNKYYADSVKGRFTISRDNSKNT LYLQMNSLRAEDTAVYYCARFSGWPNNYYYYGMDV WGQGTTVTVSS |
| 194 | DVD536L AB033VL | AB005VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPSVFIFPPDVVMTQSPLSLPVTPGEPAS ISCRSSQSLLHSNGFNYVDWYLQKPGQSPHLLIYF GSYRASGVPDRFSGSGSGTDFTLKISRVEAEDVGV YYCMQALQTPPWTFGQGTKVEIRR |

Example 2.25

Generation of EGFR (Seq. 2) and RON (Seq. 1)
DVD-Igs with Linker Set 3

TABLE 57

| DVD SEQ ID NO | Outer Variable Domain Name | Inner Variable Domain Name | Sequence 123456789012345678901234567890123456789012345 |
|---|---|---|---|
| 195 | DVD537H AB005VH | AB033VH | EVQLVQSGGGLVKPGGSLRLSCAASGFTFSSYAMH WVRQAPGKGLEWVAVISYDGSNKYYADSVKGRFTI SRDNSKNTLYLQMNSLRAEDTAVYYCARFSGWPNN YYYYGMDVWGQGTTVTVSSASTKGPSVFPLAPQVQ LKQSGPGLVQPSQSLSITCTVSGFSLTNYGVHWVR QSPGKGLEWLGVIWSGGNTDYNTPFTSRLSINKDN SKSQVFFKMNSLQSNDTAIYYCARALTYYDYEFAY WGQGTLVTVSA |
| 196 | DVD537L AB005VL | AB033VL | DVVMTQSPLSLPVTPGEPASISCRSSQSLLHSNGF NYVDWYLQKPGQSPHLLIYFGSYRASGVPDRFSGS GSGTDFTLKISRVEAEDVGVYYCMQALQTPPWTFG QGTKVEIRRTVAAPDILLTQSPVILSVSPGERVSF SCRASQSIGTNIHWYQQRTNGSPRLLIKYASESIS GIPSRFSGSGSGTDFTLSINSVESEDIADYYCQQN NNWPTTFGAGTKLELKR |

TABLE 57-continued

| DVD SEQ ID NO | DVD Variable Domain Name | Outer Variable Domain Name | Inner Variable Domain Name | Sequence 123456789012345678901234567890123456789012345 |
|---|---|---|---|---|
| 197 | DVD538H | AB033VH | AB005VH | QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSSAASTKGPSVFPLAPEVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSS |
| 198 | DVD538L | AB033VL | AB005VL | DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRR |

Example 2.26

Generation of EGFR (Seq. 2) and RON (Seq. 1) DVD-Igs with Linker Set 4

TABLE 58

| DVD SEQ ID NO | DVD Variable Domain Name | Outer Variable Domain Name | Inner Variable Domain Name | Sequence 123456789012345678901234567890123456789012345 |
|---|---|---|---|---|
| 199 | DVD539H | AB005VH | AB033VH | EVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA |
| 200 | DVD539L | AB005VL | AB033VL | DVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRRTVAAPSVFIFPPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR |
| 201 | DVD540H | AB033VH | AB005VH | QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPEVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSS |
| 202 | DVD540L | AB033VL | AB005VL | DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPDVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRR |

Example 2.27

Generation of EGFR (Seq. 2) and HGF (Seq. 1) DVD-Igs

TABLE 59

| DVD SEQ ID NO | Domain Name | Outer Variable Domain Name | Inner Variable Domain Name | Sequence |
|---|---|---|---|---|
| 203 | DVD025H | AB033VH | AB012VH | QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS |
| 204 | DVD025L | AB033VL | AB012VL | DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR |
| 205 | DVD026H | AB012VH | AB033VH | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA |
| 206 | DVD026L | AB012VL | AB033VL | DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR |

Example 2.28

Generation of EGFR (Seq. 2) and c-MET DVD-Igs

TABLE 60

| DVD SEQ ID NO | Domain Name | Outer Variable Domain Name | Inner Variable Domain Name | Sequence |
|---|---|---|---|---|
| 207 | DVD027H | AB033VH | AB013VH | QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPQVQLQQSGPELVRPGASVKWSCPASGYTFTSYWLHWVKKQRPGQGLEWIGMIDPSNSDTRFNPPNFKDKATLNVDRSSNTAYNLLSSLTSADSAVYYCATYGSYVSPLDYWGQGTSVYVSS |
| 208 | DVD027L | AB033VL | AB013VL | DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDIMMSQSPSSLTVSVGEKVTVSCKSSQSLLVTSSQKNYLAWYQQKPQQSPKLLIYWASTRESGVPDRFTGSGSGTDFTLTITSVKADDLAVYYCQQYYAYPWTFGDGTKLEIKR |
| 209 | DVD028H | AB013VH | AB033VH | QVQLQQSGPELVRPGASVKWSCPASGYTFTSYWLHWVKKQRPGQGLEWIGMIDPSNSDTRFNPPNFKDKATLNVDRSSNTAYNLLSSLTSADSAVYYCATYGSYV |

TABLE 60-continued

| DVD SEQ ID NO | Outer Variable Domain Name | Inner Variable Domain Name | Sequence 123456789012345678901234567890123 45 |
|---|---|---|---|
| | | | SPLDYWGQGTSVYVSSASTKGPQVQLKQSGPGLVQ PSQSLSITCTVSGFSLTNYGVHWVRQSPGKGLEWL GVIWSGGNTDYNTPFTSRLSINKDNSKSQVFFKMN SLQSNDTAIYYCARALTYYDYEFAYWGQGTLVTSA |
| 210 DVD028L | AB013VL | AB033VL | DIMMSQSPSSLTVSVGEKVTVSCKSSQSLLVTSSQ KNYLAWYQQKPQQSPKLLIYWASTRESGVPDRFTG SGSGTDFTLTITSVKADDLAVYYCQQYYAYPWTFG DGTKLEIKRTVAAPDILLTQSPVILSVSPGERVSF SCRASQSIGTNIHWYQQRTNGSPRLLIKYASESIS GIPSRFSGSGSGTDFTLSINSVESEDIADYYCQQN NNWPTTFGAGTKLELKR |

Example 2.29

Generation of HER-2 (Seq. 1) and IGF1,2 DVD-Igs

TABLE 61

| DVD SEQ ID NO | Outer Variable Domain Name | Inner Variable Domain Name | Sequence 123456789012345678901234567890123 45 |
|---|---|---|---|
| 211 DVD029H | AB004VH | AB010VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPQVQLVQSGAEVKKP GASVKVSCKASGYTFTSYDINWVRQATGQGLEWMG WMNPNSGNTGYAQKFQGRVTMTRNTSISTAYMELS SLRSEDTAVYYCARDPYYYYGMDVWGQGTTVTVSS |
| 212 DVD029L | AB004VL | AB010VL | DIQMTQSPSSLSASVGDRVTITCRASQDVNTAVAW YQQKPGKARKLLIYSASFLYSGVPSRFSGSRSGTD FTLTISSLQPEDFATYYCQQHYTTPPTFGQGTKVE IKRTVAAPQSVLTQPPSVSAAPGQKVTISCSGSSS NIENNHVSWYQQLPGTAPKLLIYDNNKRPSGIPDR FSGSKSGTSATLGITGLQTGDEADYYCETWDTSLS AGRVFGGGTKLTVLG |
| 213 DVD030H | AB010VH | AB004VH | QVQLVQSGAEVKKPGASVKVSCKASGYTFTSYDIN WVRQATGQGLEWMGWMNPNSGNTGYAQKFQGRVTM TRNTSISTAYMELSSLRSEDTAVYYCARDPYYYYY GMDVWGQGTTVTVSSASTKGPEVQLVESGGGLVQP GGSLRLSCAASGFNIKDTYIHWVRQAPGKGLEWVA RIYPTNGYTRYADSVKGRFTISADTSKNTAYLQMN SLRAEDTAVYYCSRWGGDGFYAMDYWGQGTLVTVSS |
| 214 DVD030L | AB010VL | AB004VL | QSVLTQPPSVSAAPGQKVTISCSGSSSNIENNHVS WYQQLPGTAPKLLIYDNNKRPSGIPDRFSGSKSGT SATLGITGLQTGDEADYYCETWDTSLSAGRVFGGG TKLTVLGQPKAAPDIQMTQSPSSLSASVGDRVTIT CRASQDVNTAVAWYQQKPGKAPKLLIYSASFLYSG VPSRFSGSRSGTDFTLTISSLQPEDFATYYCQQHY TTPPTFGQGTKVEIKR |

Example 2.30

Generation of HER-2 (Seq. 1) and IGF1R DVD-Igs

TABLE 62

| DVD SEQ ID NO | DVD Variable Domain Name | Outer Variable Domain Name | Inner Variable Domain Name | Sequence |
|---|---|---|---|---|
| 215 | DVD031H | AB004VH | AB011VH | EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPEVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSS |
| 216 | DVD031L | AB004VL | AB011VL | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPDIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKR |
| 217 | DVD032H | AB011VH | AB004VH | EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS |
| 218 | DVD032L | AB011VL | AB004VL | DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR |

Example 2.31

Generation of RON (Seq. 1) and HGF (Seq. 1) DVD-Igs

TABLE 63

| DVD SEQ ID NO | DVD Variable Domain Name | Outer Variable Domain Name | Inner Variable Domain Name | Sequence |
|---|---|---|---|---|
| 219 | DVD033H | AB005VH | AB012VH | EVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSSASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS |
| 220 | DVD033L | AB005VL | AB012VL | DVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR |
| 221 | DVD034H | AB012VH | AB005VH | QVQLVESGGGLVKPGGSLRLSCAASGFTFSDYYMSWIRQAPGKGLEWVSYISSSGSTIYYADSVKGRFTI |

TABLE 63-continued

| DVD SEQ ID NO | DVD Variable Domain Name | Outer Variable Domain Name | Inner Variable Domain Name | Sequence 123456789012345678901234567890123456789012345 |
|---|---|---|---|---|
| | | | | SRDNAKNSLYLQMNSLRAEDTAVYYCARDEYNSGW YVLFDYWGQGTLVTVSSASTKGPEVQLVQSGGGLV KPGGSLRLSCAASGFTFSSYAMHWVRQAPGKGLEW VAVISYDGSNKYYADSVKGRFTISRDNSKNTLYLQ MNSLRAEDTAVYYCARFSGWPNNYYYYGMDVWGQG TTVTVSS |
| 222 | DVD034L | AB012VL | AB005VL | DIQMTQSPSSVSASVGDRVTITCRASQGISSWLAW YQQKPGKAPNLLIYEASSLQSGVPSRFGGSGSGTD FTLTISSLQPEDFATYYCQQANGFPWTFGQGTKVE IKRTVAAPDVVMTQSPLSLPVTPGEPASISCRSSQ SLLHSNGFNYVDWYLQKPGQSPHLLIYFGSYRASG VPDRFSGSGSGTDFTLKISRVEAEDVGVYYCMQAL QTPPWTFGQGTKVEIRR |

Example 2.32

Generation of VEGF (Seq. 1) and EGFR (Seq. 2) DVD-Igs

TABLE 64

| DVD SEQ ID NO | DVD Variable Domain Name | Outer Variable Domain Name | Inner Variable Domain Name | Sequence 123456789012345678901234567890123456789012345 |
|---|---|---|---|---|
| 223 | DVD035H | AB014VH | AB033VH | EVQLVESGGGLVQPGGSLRLSCAASGYTFTNYGMN WVRQARGKGLEWVGWINTYTGEPTYAADFKRRFTF SLDTSKSTAYLQMNSLRAEDTAVYYCAKYPHYYGS SHWYFDVWGQGTLVTVSSASTKGPQVQLKQSGPGL VQPSQSLSITCTVSGFSLTNYGVHWVRQSPGKGLE WLGVIWSGGNTDYNTPFTSRLSINKDNSKSQVFFK MNSLQSNDTAIYYCARALTYYDYEFAYWGQGTLVT VSA |
| 224 | DVD035L | AB014VL | AB033VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDILLTQSPVILSVSPGERVSFSCRASQ SIGTNIHWYQQRTNGSPRLLIKYASESISGIPSRF SGSGSGTDFTLSINSVESEDIADYYCQQNNNWPTT FGAGTKLELKR |
| 225 | DVD036H | AB033VH | AB014VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPEVQLVESGGGLVQPG GSLRLSCAASGYTFTNYGMNWVRQAPGKGLEWVGW INTYTGEPTYAADFKRRFTFSLDTSKSTAYLQMNS LRAEDTAVYYCAKYPHYYGSSHWYFDVWGQGTLVT VSS |
| 226 | DVD036L | AB033VL | AB014VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |

Example 2.33

Generation of VEGF (Seq. 1) and HER-2 (Seq. 1) DVD-Igs

TABLE 65

| DVD SEQ ID NO | Variable Domain Name | Outer Variable Domain Name | Inner Variable Domain Name | Sequence 12345678901234567890123456789012345 |
|---|---|---|---|---|
| 227 | DVD037H | AB014VH | AB004VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPEVQLVESGGGL VQPGGSLRLSCAASGFNIKDTYIHWVRQAPGKGLE WVARIYPTNGYTRYADSVKGRFTISADTSKNTAYL QMNSLRAEDTAVYYCSRWGGDGFYAMDYWGQGTLV TVSS |
| 228 | DVD037L | AB014VL | AB004VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSPSSLSASVGDRVTITCRASQ DVNTAVAWYQQKPGKAPKLLIYSASFLYSGVPSRF SGSRSGTDFTLTISSLQPEDFATYYCQQHYTTPPT FGQGTKVEIKR |
| 229 | DVD038H | AB004VH | AB014VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPEVQLVESGGGLVQP GGSLRLSCAASGYTFTNYGMNWVRQAPGKGLEWVG WINTYTGEPTYAADFKRRFTFSLDTSKSTAYLQMN SLRAEDTAVYYCAKYPHYYGSSHWYFDVWGQGTLV TVSS |
| 230 | DVD038L | AB004VL | AB014VL | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |

Example 2.34

Generation of VEGF (Seq. 1) and CD-20 DVD-Igs

TABLE 66

| DVD SEQ ID NO | Variable Domain Name | Outer Variable Domain Name | Inner Variable Domain Name | Sequence 12345678901234567890123456789012345 |
|---|---|---|---|---|
| 231 | DVD039H | AB014VH | AB001VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLQQPGAEL VKPGASVKMSCKASGYTFTSYNMHWVKQTPGRGLE WIGAIYPGNGDTSYNQKFKGKATLTADKSSSTAYM QLSSLTSEDSAVYYCARSTYYGGDWYFNVWGAGTT VTVSA |
| 232 | DVD039L | AB014VL | AB001VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPQIVLSQSPAILSPSPGEKVTMTCRASS SVSYIHWFQQKPGSSPKPWIYATSNLASGVPVRFS GSGSGTSYSLTISRVEAEDAATYYCQQWTSNPPTF GGGTKLEIKR |
| 233 | DVD040H | AB001VH | AB014VH | QVQLQQPGAELVKPGASVKMSCKASGYTFTSYNMH WVKQTPGRGLEWIGAIYPGNGDTSYNQKFKGKATL TADKSSSTAYMQLSSLTSEDSAVYYCARSTYYGGD |

TABLE 66-continued

| DVD SEQ ID NO | Outer Variable Domain Name | Inner Variable Domain Name | Sequence 123456789012345678901234567890123456789012345 |
|---|---|---|---|
| | | | WYFNVWGAGTTVTVSAASTKGPEVQLVESGGGLVQ PGGSLRLSCAASGYTFTNYGMNWVRQAPGKGLEWV GWINTYTGEPTYAADFKRRFTFSLDTSKSTAYLQM NSLRAEDTAVYYCAKYPHYYGSSHWYFDVWGQGTL VTVSS |
| 234 | DVD040L | AB001VL | AB014VL | QIVLSQSPAILSPSPGEKVTMTCRASSSVSYIHWF QQKPGSSPKPWIYATSNLASGVPVRFSGSGSGTSY SLTISRVEAEDAATYYCQQWTSNPPTFGGGTKLEI KRTVAAPDIQMTQSPSSLSASVGDRVTITCSASQD ISNYLNWYQQKPGKAPKVLIYFTSSLHSGVPSRFS GSGSGTDFTLTISSLQPEDFATYYCQQYSTVPWTF GQGTKVEIKR |

Example 2.35

Generation of VEGF (Seq. 1) and IGF1,2 DVD-Igs

TABLE 67

| DVD SEQ ID NO | Outer Variable Domain Name | Inner Variable Domain Name | Sequence 123456789012345678901234567890123456789012345 |
|---|---|---|---|
| 235 | DVD041H | AB014VH | AB010VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLVQSGAEV KKPGASVKVSCKASGYTFTSYDINWVRQATGQGLE WMGWMNPNSGNTGYAQKFQGRVTMTRNTSISTAYM ELSSLRSEDTAVYYCARDPYYYYGMDVWGQGTTV TVSS |
| 236 | DVD041L | AB014VL | AB010VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPQSVLTQPPSVSAAPGQKVTISCSGSSS NIENNHVSWYQQLPGTAPKLLIYDNNKRPSGIPDR FSGSKSGTSATLGITGLQTGDEADYYCETWDTSLS AGRVFGGGTKLTVLG |
| 237 | DVD042H | AB010VH | AB014VH | QVQLVQSGAEVKKPGASVKVSCKASGYTFTSYDIN WVRQATGQGLEWMGWMNPNSGNTGYAQKFQGRVTM TRNTSISTAYMELSSLRSEDTAVYYCARDPYYYYY GMDVWGQGTTVTVSSASTKGPEVQLVESGGGLVQP GGSLRLSCAASGYTFTNYGMNWVRQAPGKGLEWVG WINTYTGEPTYAADFKRRFTFSLDTSKSTAYLQMN SLRAEDTAVYYCAKYPHYYGSSHWYFDVWGQGTLV TVSS |
| 238 | DVD042L | AB010VL | AB014VL | QSVLTQPPSVSAAPGQKVTISCSGSSSNIENNHVS WYQQLPGTAPKLLIYDNNKRPSGIPDRFSGSKSGT SATLGITGLQTGDEADYYCETWDTSLSAGRVFGGG TKLTVLGQPKAAPDIQMTQSPSSLSASVGDRVTIT CSASQDISNYLNWYQQKPGKAPKVLIYFTSSLHSG VPSRFSGSGSGTDFTLTISSLQPEDFATYYCQQYS TVPWTFGQGTKVEIKR |

Example 2.36

Generation of VEGF (Seq. 1) and DLL4 (Seq. 1) DVD-Igs

TABLE 68

| DVD SEQ ID NO | Domain Name | Outer Variable Domain Name | Inner Variable Domain Name | Sequence 12345678901234567890123456789012345 |
|---|---|---|---|---|
| 239 | DVD043H | AB014VH | AB015VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPEVQLVESGGGL VQPGGSLRLSCAASGFTFTDNWISWVRQAPGKGLE WVGYISPNSGFTYYADSVKGRFTISADTSKNTAYL QMNSLRAEDTAVYYCARDNFGGYFDYWGQGTLVTV SS |
| 240 | DVD043L | AB014VL | AB015VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSPSSLSASVGDRVTITCRASQ DVSTAVAWYQQKPGKAPKLLIYSASFLYSGVPSRF SGSGSGTDFTLTISSLQPEDFATTYYCQQSYTGTV TFGQGTKVEIKR |
| 241 | DVD044H | AB015VH | AB014VH | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPEVQLVESGGGLVQPGG SLRLSCAASGYTFTNYGMNWVRQAPGKGLEWVGWI NTYTGEPTYAADFKRRFTFSLDTSKSTAYLQMNSL RAEDTAVYYCAKYPHYYGSSHWYFDVWGQGTLVTV SS |
| 242 | DVD044L | AB015VL | AB014VL | DIQMTQSPSSLSASVGDRVTITCRASQDVSTAVAW YQQKPGKAPKLLIYSASFLYSGVPSRFSGSGSGTD FTLTISSLQPEDFATTYYCQQSYTGTVTFGQGTKV EIKRTVAAPDIQMTQSPSSLSASVGDRVTITCSAS QDISNYLNWYQQKPGKAPKVLIYFTSSLHSGVPSR FSGSGSGTDFTLTISSLQPEDFATYYCQQYSTVPW TFGQGTKVEIKR |

Example 2.37

Generation of VEGF (Seq. 1) and HGF (Seq. 1) DVD-Igs with Linker Set 1

TABLE 69

| DVD SEQ ID NO | Domain Name | Outer Variable Domain Name | Inner Variable Domain Name | Sequence 12345678901234567890123456789012345 |
|---|---|---|---|---|
| 243 | DVD045H | AB014VH | AB012VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLVESGGGL VKPGGSLRLSCAASGFTFSDYYMSWIRQAPGKGLE WVSYISSSGSTIYYADSVKGRFTISRDNAKNSLYL QMNSLRAEDTAVYYCARDEYNSGWYVLFDYWGQGT LVTVSS |
| 244 | DVD045L | AB014VL | AB012VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSPSSVSASVGDRVTITCRASQ GISSWLAWYQQKPGKAPNLLIYEASSLQSGVPSRF GGSGSGTDFTLTISSLQPEDFATYYCQQANGFPWT FGQGTKVEIKR |

TABLE 69-continued

| DVD SEQ ID NO | DVD Variable Domain Name | Outer Variable Domain Name | Inner Variable Domain Name | Sequence 12345678901234567890123456789012345 |
|---|---|---|---|---|
| 245 | DVD046H | AB012VH | AB014VH | QVQLVESGGGLVKPGGSLRLSCAASGFTFSDYYMS WIRQAPGKGLEWVSYISSSGSTIYYADSVKGRFTI SRDNAKNSLYLQMNSLRAEDTAVYYCARDEYNSGW YVLFDYWGQGTLVTVSSASTKGPEVQLVESGGGLV QPGGSLRLSCAASGYTFTNYGMNWVRQAPGKGLEW VGWINTYTGEPTYAADFKRRFTFSLDTSKSTAYLQ MNSLRAEDTAVYYCAKYPHYYGSSHWYFDVWGQGT LVTVSS |
| 246 | DVD046L | AB012VL | AB014VL | DIQMTQSPSSVSASVGDRVTITCRASQGISSWLAW YQQKPGKAPNLLIYEASSLQSGVPSRFGGSGSGTD FTLTISSLQPEDFATYYCQQANGFPWTFGQGTKVE IKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |

Example 2.38

Generation of VEGF (Seq. 1) and HGF (Seq. 1) DVD-Igs with Linker Set 2

TABLE 70

| DVD SEQ ID NO | DVD Variable Domain Name | Outer Variable Domain Name | Inner Variable Domain Name | Sequence 12345678901234567890123456789012345 |
|---|---|---|---|---|
| 247 | DVD641H | AB012VH | AB014VH | QVQLVESGGGLVKPGGSLRLSCAASGFTFSDYYMS WIRQAPGKGLEWVSYISSSGSTIYYADSVKGRFTI SRDNAKNSLYLQMNSLRAEDTAVYYCARDEYNSGW YVLFDYWGQGTLVTVSSASTKGPSVFPLAPEVQLV ESGGGLVQPGGSLRLSCAASGYTFTNYGMNWVRQA PGKGLEWVGWINTYTGEPTYAADFKRRFTFSLDTS KSTAYLQMNSLRAEDTAVYYCAKYPHYYGSSHWYF DVWGQGTLVTVSS |
| 248 | DVD641L | AB012VL | AB014VL | DIQMTQSPSSVSASVGDRVTITCRASQGISSWLAW YQQKPGKAPNLLIYEASSLQSGVPSRFGGSGSGTD FTLTISSLQPEDFATYYCQQANGFPWTFGQGTKVE IKRTVAAPSVFIFPPDIQMTQSPSSLSASVGDRVT ITCSASQDISNYLNWYQQKPGKAPKVLIYFTSSLH SGVPSRFSGSGSGTDFTLTISSLQPEDFATYYCQQ YSTVPWTFGQGTKVEIKR |
| 249 | DVD642H | AB014VH | AB012VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPQVQL VESGGGLVKPGGSLRLSCAASGFTFSDYYMSWIRQ APGKGLEWVSYISSSGSTIYYADSVKGRFTISRDN AKNSLYLQMNSLRAEDTAVYYCARDEYNSGWYVLF DYWGQGTLVTVSS |
| 250 | DVD642L | AB014VL | AB012VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPDIQMTQSPSSVSASVGDRVT ITCRASQGISSWLAWYQQKPGKAPNLLIYEASSLQ SGVPSRFGGSGSGTDFTLTISSLQPEDFATYYCQQ ANGFPWTFGQGTKVEIKR |

Example 2.39

Generation of VEGF (Seq. 1) and HGF (Seq. 1)
DVD-Igs with Linker Set 3

TABLE 71

| DVD SEQ ID NO | Outer Variable Domain Name | Inner Variable Domain Name | Sequence 12345678901234567890123456789012345 |
|---|---|---|---|
| 251 DVD647H | AB012VH | AB014VH | QVQLVESGGGLVKPGGSLRLSCAASGFTFSDYYMS WIRQAPGKGLEWVSYISSSGSTIYYADSVKGRFTI SRDNAKNSLYLQMNSLRAEDTAVYYCARDEYNSGW YVLFDYWGQGTLVTVSSASTKGPSVFPLAPEVQLV ESGGGLVQPGGSLRLSCAASGYTFTNYGMNWVRQA PGKGLEWVGWINTYTGEPTYAADFKRRFTFSLDTS KSTAYLQMNSLRAEDTAVYYCAKYPHYYGSSHWYF DVWGQGTLVTVSS |
| 252 DVD647L | AB012VL | AB014VL | DIQMTQSPSSVSASVGDRVTITCRASQGISSWLAW YQQKPGKAPNLLIYEASSLQSGVPSRFGGSGSGTD FTLTISSLQPEDFATYYCQQANGFPWTFGQGTKVE IKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |
| 253 DVD648H | AB014VH | AB012VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPQVQL VESGGGLVKPGGSLRLSCAASGFTFSDYYMSWIRQ APGKGLEWVSYISSSGSTIYYADSVKGRFTISRDN AKNSLYLQMNSLRAEDTAVYYCARDEYNSGWYVLF DYWGQGTLVTVSS |
| 254 DVD648L | AB014VL | AB012VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSPSSVSASVGDRVTITCRASQ GISSWLAWYQQKPGKAPNLLIYEASSLQSGVPSRF GGSGSGTDFTLTISSLQPEDFATYYCQQANGFPWT FGQGTKVEIKR |

Example 2.40

Generation of VEGF (Seq. 1) and HGF (Seq. 1)
DVD-Igs with Linker Set 4

TABLE 72

| DVD SEQ ID NO | Outer Variable Domain Name | Inner Variable Domain Name | Sequence 12345678901234567890123456789012345 |
|---|---|---|---|
| 255 DVD653H | AB012VH | AB014VH | QVQLVESGGGLVKPGGSLRLSCAASGFTFSDYYMS WIRQAPGKGLEWVSYISSSGSTIYYADSVKGRFTI SRDNAKNSLYLQMNSLRAEDTAVYYCARDEYNSGW YVLFDYWGQGTLVTVSSASTKGPEVQLVESGGGLV QPGGSLRLSCAASGYTFTNYGMNWVRQAPGKGLEW VGWINTYTGEPTYAADFKRRFTFSLDTSKSTAYLQ MNSLRAEDTAVYYCAKYPHYYGSSHWYFDVWGQGT LVTVSS |
| 256 DVD653L | AB012VL | AB014VL | DIQMTQSPSSVSASVGDRVTITCRASQGISSWLAW YQQKPGKAPNLLIYEASSLQSGVPSRFGGSGSGTD FTLTISSLQPEDFATYYCQQANGFPWTFGQGTKVE IKRTVAAPSVFIFPPDIQMTQSPSSLSASVGDRVT ITCSASQDISNYLNWYQQKPGKAPKVLIYFTSSLH SGVPSRFSGSGSGTDFTLTISSLQPEDFATYYCQQ YSTVPWTFGQGTKVEIKR |

TABLE 72-continued

| DVD SEQ ID NO | DVD Variable Domain Name | Outer Variable Domain Name | Inner Variable Domain Name | Sequence |
|---|---|---|---|---|
| 257 | DVD654H | AB014VH | AB012VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLVESGGGL VKPGGSLRLSCAASGFTFSDYYMSWIRQAPGKGLE WVSYISSSGSTIYYADSVKGRFTISRDNAKNSLYL QMNSLRAEDTAVYYCARDEYNSGWYVLFDYWGQGT LVTVSS |
| 258 | DVD654L | AB014VL | AB012VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPDIQMTQSPSSVSASVGDRVT ITCRASQGISSWLAWYQQKPGKAPNLLIYEASSLQ SGVPSRFGGSGSGTDFTLTISSLQPEDFATYYCQQ ANGFPWTFGQGTKVEIKR |

Example 2.41

Generation of VEGF (Seq. 1) and RON (Seq. 1) DVD-Igs

TABLE 73

| DVD SEQ ID NO | DVD Variable Domain Name | Outer Variable Domain Name | Inner Variable Domain Name | Sequence |
|---|---|---|---|---|
| 259 | DVD047H | AB014VL | AB005VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYRHYYGS SHWYFDVWGQGTLVTVSSASTKGPEVQLVQSGGGL VKPGGSLRLSCAASGFTFSSYAMHWVRQAPGKGLE WVAVISYDGSNKYYADSVKGRFTISRDNSKNTLYL QMNSLRAEDTAVYYCARFSGWPNNYYYYGMDVWGQ GTTVTVSS |
| 260 | DVD047L | AB014VH | AB005VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDVVMTQSPLSLPVTPGEPASISCRSSQ SLLHSNGFNYVDWYLQKPGQSPHLLIYFGSYRASG VPDRFSGSGSGTDFTLKISRVEAEDVGVYYCMQAL QTPPWTFGQGTKVEIRR |
| 261 | DVD048H | AB005VH | AB014VL | EVQLVQSGGGLVKPGGSLRLSCAASGFTFSSYAMH WVRQAPGKGLEWVAVISYDGSNKYYADSVKGRFTI SRDNSKNTLYLQMNSLRAEDTAVYYCARFSGWPNN YYYYGMDVWGQGTTVTVSSASTKGPEVQLVESGGG LVQPGGSLRLSCAASGYTFTNYGMNWVRQAPGKGL EWVGWINTYTGEPTYAADFKRRFTFSLDTSKSTAY LQMNSLRAEDTAVYYCAKYPHYYGSSHWYFDVWGQ GTLVTVSS |
| 262 | DVD048L | AB005VL | AB014VH | DVVMTQSPLSLPVTPGEPASISCRSSQSLLHSNGF NYVDWYLQKPGQSPHLLIYFGSYRASGVPDRFSGS GSGTDFTLKISRVEAEDVGVYYCMQALQTPPWTFG QGTKVEIRRTVAAPDIQMTQSPSSLSASVGDRVTI TCSASQDISNYLNWYQQKPGKAPKVLIYFTSSLHS GVPSRFSGSGSGTDFTLTISSLQPEDFATYYCQQY STVPWTFGQGTKVEIKR |

Example 2.42

Generation of VEGF (Seq. 1) and NRP1 (Seq. 1) DVD-Igs

TABLE 74

| DVD SEQ ID NO | Outer Variable Domain Name | Inner Variable Domain Name | Sequence 123456789012345678901234567890123456789012345 |
|---|---|---|---|
| 263 | DVD049H | AB014VH | AB016VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPEVQLVESGGGL VQPGGSLRLSCAASGFSFSSEPISWVRQAPGKGLE WVSSITGKNGYTYYADSVKGRFTISADTSKNTAYL QMNSLRAEDTAVYYCARWGKKVYGMDVWGQGTLVT VSS |
| 264 | DVD049L | AB014VL | AB016VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSPSSLSASVGDRVTITCRASQ SISSYLAWYQQKRGKAPKLLIYGASSRASGVPSRF SGSGSGTDFTLTISSLQPEDFATYYCQQYMSVPIT FGQGTKVEIKR |
| 265 | DVD050H | AB016VH | AB014VH | EVQLVESGGGLVQPGGSLRLSCAASGFSFSSEPIS WVRQAPGKGLEWVSSITGKNGYTYYADSVKGRFTI SADTSKNTAYLQMNSLRAEDTAVYYCARWGKKVYG MDVWGQGTLVTVSSASTKGPEVQLVESGGGLVQPG GSLRLSCAASGYTFTNYGMNWVRQAPGKGLEWVGW INTYTGEPTYAADFKRRFTFSLDTSKSTAYLQMNS LRAEDTAVYYCAKYPHYYGSSHWYFDVWGQGTLVT VSS |
| 266 | DVD050L | AB016VL | AB014VL | DIQMTQSPSSLSASVGDRVTITCRASQSISSYLAW YQQKPGKAPKLLIYGASSRASGVPSRFSGSGSGTD FTLTISSLQPEDFATYYCQQYMSVPITFGQGTKVE IKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |

Example 2.43

Generation of HGF (Seq. 1) and RON (Seq. 2) DVD-Igs

TABLE 75

| DVD SEQ ID NO | Outer Variable Domain Name | Inner Variable Domain Name | Sequence 123456789012345678901234567890123456789012345 |
|---|---|---|---|
| 267 | DVD073H | AB034VH | AB012VH | QVQLQESGPGLVKPSEILSLTCTVSGGSISSHYWS WVRQPPGKGLEWIGYIYYSGSTNYNPSLKSRVTIS VDTSKNQFSLNLSSVTAADTAVYYCARIPNYYDRS GYYPGYWYFDLWGRGTLVTVSSASTKGPQVQLVES GGGLVKPGGSLRLSCAASGFTFSDYYMSWIRQAPG KGLEWVSYISSSGSTIYYADSVKGRFTISRDNAKN SLYLQMNSLRAEDTAVYYCARDEYNSGWYVLFDYW GQGTLVTVSS |
| 268 | DVD073L | AB034VL | AB012VL | QAVLTQPSSLSAPPGASASLTCTLRSGFNVDSYRI SWYQQKPGSPPQYLLRYKSDSDKQQGSGVPSRFSG SKDASANAGILLISGLQSEDEADYYCMIWHSSAWV FGGGTKLTVLRTVAAPDIQMTQSPSSVSASVGDRV TITCRASQGISSWLAWYQQKPGKAPNLLIYEASSL QSGVPSRFGGSGSGTDFTLTISSLQPEDFATYYCQ QANGFPWTFGQGTKVEIKR |

TABLE 75-continued

| DVD SEQ ID NO | Outer Variable Domain Name | Inner Variable Domain Name | Sequence 123456789012345678901234567890123456 |
|---|---|---|---|
| 269 | DVD074H AB012VH | AB034VH | QVQLVESGGGLVKPGGSLRLSCAASGFTFSDYYMS WIRQAPGKGLEWVSYISSSGSTIYYADSVKGRFTI SRDNAKNSLYLQMNSLRAEDTAVYYCARDEYNSGW YVLFDYWGQGTLVTVSSASTKGPQVQLQESGPGLV KPSEILSLTCTVSGGSISSHYWSWVRQPPGKGLEW IGYIYYSGSTNYNPSLKSRVTISVDTSKNQFSLNL SSVTAADTAVYYCARIPNYYDRSGYYPGYWYFDLW GRGTLVTVSS |
| 270 | DVD074L AB012VL | AB034VL | DIQMTQSPSSVSASVGDRVTITCRASQGISSWLAW YQQKPGKAPNLLIYEASSLQSGVPSRFGGSGSGTD FTLTISSLQPEDFATYYCQQANGFPWTFGQGTKVE IKRTVAAPQAVLTQPSSLSAPPGASASLTCTLRSG FNVDSYRISWYQQKPGSPPQYLLRYKSDSDKQQGS GVPSRFSGSKDASANAGILLISGLQSEDEADYYCM IWHSSAWVFGGGTKLTVLR |

Example 2.44

Generation of EGFR (Seq. 2) and RON (Seq. 2) DVD-Igs

TABLE 76

| DVD SEQ ID NO | Outer Variable Domain Name | Inner Variable Domain Name | Sequence 123456789012345678901234567890123456 |
|---|---|---|---|
| 271 | DVD075H AB034VH | AB033VH | QVQLQESGPGLVKPSEILSLTCTVSGGSISSHYWS WVRQPPGKGLEWIGYIYYSGSTNYNPSLKSRVTIS VDTSKNQFSLNLSSVTAADTAVYYCARIPNYYDRS GYYPGYWYFDLWGRGTLVTVSSASTKGPQVQLKQS GPGLVQPSQSLSITCTVSGFSLTNYGVHWVRQSPG KGLEWLGVIWSGGNTDYNTPFTSRLSINKDNSKSQ VFFKMNSLQSNDTAIYYCARALTYYDYEFAYWGQG TLVTVSA |
| 272 | DVD075L AB034VL | AB033VL | QAVLTQPSSLSAPPGASASLTCTLRSGFNVDSYRI SWYQQKPGSPPQYLLRYKSDSDKQQGSGVPSRFSG SKDASANAGILLISGLQSEDEADYYCMIWHSSAWV FGGGTKLTVLRTVAAPDILLTQSPVILSVSPGERV SFSCRASQSIGTNIHWYQQRTNGSPRLLIKYASES ISGIPSRFSGSGSGTDFTLSINSVESEDIADYYCQ QNNNWPTTFGAGTKLELKR |
| 273 | DVD076H AB033VH | AB034VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPQVQLQESGPGLVKPS EILSLTCTVSGGSISSHYWSWVRQPPGKGLEWIGY IYYSGSTNYNPSLKSRVTISVDTSKNQFSLNLSSV TAADTAVYYCARIPNYYDRSGYYPGYWYFDLWGRG TLVTVSS |
| 274 | DVD076L AB033VL | AB034VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPQAVLTQPSSLSAPPGASASLTCTLRSG FNVDSYRISWYQQKPGSPPQYLLRYKSDSDKQQGS GVPSRFSGSKDASANAGILLISGLQSEDEADYYCM IWHSSAWVFGGGTKLTVLR |

Example 2.45

Generation of VEGF (Seq. 1) and RON (Seq. 2) DVD-Igs

TABLE 77

| DVD SEQ ID NO | Outer Variable Domain Name | Inner Variable Domain Name | Sequence 123456789012345678901234567890 12345 |
|---|---|---|---|
| 275 | DVD077H AB034VH | AB014VH | QVQLQESGPGLVKPSEILSLTCTVSGGSISSHYWS WVRQPPGKGLEWIGYIYYSGSTNYNPSLKSRVTIS VDTSKNQFSLNLSSVTAADTAVYYCARIPNYYDRS GYYPGYWYFDLWGRGTLVTVSSASTKGPEVQLVES GGGLVQPGGSLRLSCAASGYTFTNYGMNWVRQAPG KGLEWVGWINTYTGEPTYAADFKRRFTFSLDTSKS TAYLQMNSLRAEDTAVYYCAKYPHYYGSSHWYFDV WGQGTLVTVSS |
| 276 | DVD077L AB034VL | AB014VL | QAVLTQPSSLSAPPGASASLTCTLRSGFNVDSYRI SWYQQKPGSPPQYLLRYKSDSDKQQGSGVPSRFSG SKDASANAGILLISGLQSEDEADYYCMIWHSSAWV FGGGTKLTVLRTVAAPDIQMTQSPSSLSASVGDRV TITCSASQDISNYLNWYQQKPGKAPKVLIYFTSSL HSGVPSRFSGSGSGTDFTLTISSLQPEDFATYYCQ QYSTVPWTFGQGTKVEIKR |
| 277 | DVD078H AB014VH | AB034VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLQESGPGL VKPSEILSLTCTVSGGSISSHYWSWVRQPPGKGLE WIGYIYYSGSTNYNPSLKSRVTISVDTSKNQFSLN LSSVTAADTAVYYCARIPNYYDRSGYYPGYWYFDL WGRGTLVTVSS |
| 278 | DVD078L AB014VL | AB034VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPQAVLTQPSSLSAPPGASASLTCTLRSG FNVDSYRISWYQQKPGSPPQYLLRYKSDSDKQQGS GVPSRFSGSKDASANAGILLISGLQSEDEADYYCM IWHSSAWVFGGGTKLTVLR |

Example 2.46

Generation of EGFR (Seq. 1) and HER-2 (Seq. 1) DVD-Igs

TABLE 78

| DVD SEQ ID NO | Outer Variable Domain Name | Inner Variable Domain Name | Sequence 123456789012345678901234567890 12345 |
|---|---|---|---|
| 279 | DVD079H AB003VH | AB004VH | QVQLQESGPGLVKPSETLSLTCTVSGGSVSSGDYY WTWIRQSPGKGLEWIGHIYYSGNTNYNPSLKSRLT ISIDTSKTQFSLKLSSVTAADTAIYYCVRDRVTGA FDIWGQGTMVTVSSASTKGPEVQLVESGGGLVQPG GSLRLSCAASGFNIKDTYIHWVRQAPGKGLEWVAR IYPTNGYTRYADSVKGRFTISADTSKNTAYLQMNS LRAEDTAVYYCSRWGGDGFYAMDYWGQGTLVTVSS |
| 280 | DVD079L AB003VL | AB004VL | DIQMTQSPSSLSASVGDRVTITCQASQDISNYLNW YQQKPGKAPKLLIYDASNLETGVPSRFSGSGSGTD FTFTISSLQPEDIATYFCQHFDHLPLAFGGGTKVE IKRTVAAPDIQMTQSPSSLSASVGDRVTITCRASQ DVNTAVAWYQQKPGKAPKLLIYSASFLYSGVPSRF SGSRSGTDFTLTISSLQPEDFATYYCQQHYTTPPT FGQGTKVEIKR |
| 281 | DVD080H AB004VH | AB003VH | EVQLVESGGGLVQPGGSLRLSCAASGFNIKDTYIH WVRQAPGKGLEWVARIYPTNGYTRYADSVKGRFTI |

TABLE 78-continued

| DVD SEQ ID NO | DVD Variable Domain Name | Outer Variable Domain Name | Inner Variable Domain Name | Sequence 12345678901234567890123456789012345 |
|---|---|---|---|---|
| | | | | SADTSNTAYLQMNSLRAEDTAVYYCSRWGGDGFYAMDYWGQGTLVTVSSASTKGPQVQLQESGPGLVKPSETLSLTCTVSGGSVSSGDYYWTIRQSPGKGLEWIGHIYYSGNTNYNPSLKSRLTISIDTSKTQFSLKLSSVTAADTAIYYCVRDRVTGAFDIWGQGTMVTVSS |
| 282 | DVD080L | AB004VL | AB003VL | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR |

Example 2.47

Generation of EGFR (Seq. 1) and CD3 (Seq. 1) DVD-Igs

TABLE 79

| DVD SEQ ID NO | DVD Variable Domain Name | Outer Variable Domain Name | Inner Variable Domain Name | Sequence 12345678901234567890123456789012345 |
|---|---|---|---|---|
| 283 | DVD081H | AB003VH | AB002VH | QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS |
| 284 | DVD081L | AB003VL | AB002VL | DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPQIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINR |
| 285 | DVD082H | AB002VH | AB003VH | QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPQVQLQESGPGLVKPSETLSLTCTVSGGSVSSGDYYWTIRQSPGKGLEWIGHIYYSGNTNYNPSLKSRLTISIDTSKTQFSLKLSSVTAADTAIYYCVRDRVTGAFDIWGQGTMVTVSS |
| 286 | DVD082L | AB002VL | AB003VL | QIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR |

Example 2.48

Generation of EGFR (Seq. 1) and IGF1R DVD-Igs

TABLE 80

| DVD SEQ ID NO | Domain Name | Outer Variable Domain Name | Inner Variable Domain Name | Sequence 12345678901234567890123456789012345 |
|---|---|---|---|---|
| 287 | DVD083H | AB003VH | AB011VH | QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPEVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYGMDVWGQGTTVTVSS |
| 288 | DVD083L | AB003VL | AB011VL | DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKR |
| 289 | DVD084H | AB011VH | AB003VH | EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYGMDVWGQGTTVTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS |
| 290 | DVD084L | AB011VL | AB003VL | DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR |

Example 2.49

Generation of EGFR (Seq. 1) and RON (Seq. 1) DVD-Igs

TABLE 81

| DVD SEQ ID NO | Domain Name | Outer Variable Domain Name | Inner Variable Domain Name | Sequence 12345678901234567890123456789012345 |
|---|---|---|---|---|
| 291 | DVD085H | AB003VH | AB005VH | QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPEVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSS |
| 292 | DVD085L | AB003VL | AB005VL | DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRR |
| 293 | DVD086H | AB005VH | AB003VH | EVQLVQSGGGLVKPGGSLRLSCAASGFTFSSYAMHWVRQAPGKGLEWVAVISYDGSNKYYADSVKGRFTI |

TABLE 81-continued

| DVD SEQ ID NO | DVD Variable Domain Name | Outer Variable Domain Name | Inner Variable Domain Name | Sequence 123456789012345678901234567890123456789012345 |
|---|---|---|---|---|
| | | | | SRDNSKNTLYLQMNSLRAEDTAVYYCARFSGWPNN YYYYGMDVWGQGTTVTVSSASTKGPQVQLQESGPG LVKPSETLSLTCTVSGGSVSSGDYYWTWIRQSPGK GLEWIGHIYYSGNTNYNPSLKSRLTISIDTSKTQF SLKLSSVTAADTAIYYCVRDRVTGAFDIWGQGTMV TVSS |
| 294 | DVD086L | AB005VL | AB003VL | DVVMTQSPLSLPVTPGEPASISCRSSQSLLHSNGF NYVDWYLQKPGQSPHLLIYFGSYRASGVPDRFSGS GSGTDFTLKISRVEAEDVGVYYCMQALQTPPWTFG QGTKVEIRRTVAAPDIQMTQSPSSLSASVGDRVTI TCQASQDISNYLNWYQQKPGKAPKLLIYDASNLET GVPSRFSGSGSGTDFTFTISSLQPEDIATYFCQHF DHLPLAFGGGTKVEIKR |

Example 2.50

Generation of EGFR (Seq. 1) and RON (Seq. 2) DVD-Igs

TABLE 82

| DVD SEQ ID NO | DVD Variable Domain Name | Outer Variable Domain Name | Inner Variable Domain Name | Sequence 123456789012345678901234567890123456789012345 |
|---|---|---|---|---|
| 295 | DVD087H | AB003VH | AB034VH | QVQLQESGPGLVKPSETLSLTCTVSGGSVSSGDYY WTWIRQSPGKGLEWIGHIYYSGNTNYNPSLKSRLT ISIDTSKTQFSLKLSSVTAADTAIYYCVRDRVTGA FDIWGQGTMVTVSSASTKGPQVQLQESGPGLVKPS EILSLTCTVSGGSISSHYWSWVRQPPGKGLEWIGY IYYSGSTNYNPSLKSRVTISVDTSKNQFSLNLSSV TAADTAVYYCARIPNYYDRSGYYPGYWYFDLWGRG TLVTVSS |
| 296 | DVD087L | AB003VL | AB034VL | DIQMTQSPSSLSASVGDRVTITCQASQDISNYLNW YQQKPGKAPKLLIYDASNLETGVPSRFSGSGSGTD FTFTISSLQPEDIATYFCQHFDHLPLAFGGGTKVE IKRTVAAPQAVLTQPSSLSAPPGASASLTCTLRSG FNVDSYRISWYQQKPGSPPQYLLRYKSDSDKQQGS GVPSRFSGSKDASANAGILLISGLQSEDEADYYCM IWHSSAWVFGGGTKLTVLR |
| 297 | DVD088H | AB034VH | AB003VH | QVQLQESGPGLVKPSEILSLTCTVSGGSISSHYWS WVRQPPGKGLEWIGYIYYSGSTNYNPSLKSRVTIS VDTSKNQFSLNLSSVTAADTAVYYCARIPNYYDRS GYYPGYWYFDLWGRGTLVTVSSASTKGPQVQLQES GPGLVKPSETLSLTCTVSGGSVSSGDYYWTWIRQS PGKGLEWIGHIYYSGNTNYNPSLKSRLTISIDTSK TQFSLKLSSVTAADTAIYYCVRDRVTGAFDIWGQG TMVTVSS |
| 298 | DVD088L | AB034VL | AB003VL | QAVLTQPSSLSAPPGASASLTCTLRSGFNVDSYRI SWYQQKPGSPPQYLLRYKSDSDKQQGSGVPSRFSG SKDASANAGILLISGLQSEDEADYYCMIWHSSAWV FGGGTKLTVLRTVAAPDIQMTQSPSSLSASVGDRV TITCQASQDISNYLNWYQQKPGKAPKLLIYDASNL ETGVPSRFSGSGSGTDFTFTISSLQPEDIATYFCQ HFDHLPLAFGGGTKVEIKR |

Example 2.51

Generation of EGFR (Seq. 1) and HGF (Seq. 1) DVD-Igs

TABLE 83

| DVD SEQ ID NO | DVD Variable Domain Name | Outer Variable Domain Name | Inner Variable Domain Name | Sequence |
|---|---|---|---|---|
| 299 | DVD089H | AB003VH | AB012VH | QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS |
| 300 | DVD089L | AB003VL | AB012VL | DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR |
| 301 | DVD090H | AB012VH | AB003VH | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS |
| 302 | DVD090L | AB012VL | AB003VL | DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR |

Example 2.52

Generation of EGFR (Seq. 1) and c-MET DVD-Igs

TABLE 84

| DVD SEQ ID NO | DVD Variable Domain Name | Outer Variable Domain Name | Inner Variable Domain Name | Sequence |
|---|---|---|---|---|
| 303 | DVD091H | AB003VH | AB013VH | QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPQVQLQQSGPELVRPGASVKWSCPASGYTFTSYWLHWVKKQRPGQGLEWIGMIDPSNSDTRFNPPNFKDKATLNVDRSSNTAYNLLSSLTSADSAVYYCATYGSYVSPLDYWGQGTSVYVSS |
| 304 | DVD091L | AB003VL | AB013VL | DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDIMMSQSPSSLTVSVGEKVTVSCKSSQSLLVTSSQKNYLAWYQQKPQQSPKLLIYWASTRESGVPDRFTGSGSGTDFTLTITSVKADDLAVYYCQQYYAYPWTFGDGTKLEIKR |
| 305 | DVD092H | AB013VH | AB003VH | QVQLQQSGPELVRPGASVKWSCPASGYTFTSYWLHWVKKQRPGQGLEWIGMIDPSNSDTRFNPPNFKDKATLNVDRSSNTAYNLLSSLTSADSAVYYCATYGSYV |

TABLE 84-continued

| DVD SEQ ID NO | Outer Variable Domain Name | Inner Variable Domain Name | Sequence 123456789012345678901234567890123456 |
|---|---|---|---|
| | | | SPLDYWGQGTSVYVSSASTKGPQVQLQESGPGLVK PSETLSLTCTVSGGSVSSGDYYWTIRQSPGKGLE WIGHIYYSGNTNYNPSLKSRLTISIDTSKTQFSLK LSSVTAADTAIYYCVRDRVTGAFDIWGQGTMVTVSS |
| 306 | DVD092L | AB013VL | AB003VL | DIMMSQSPSSLTVSVGEKVTVSCKSSQSLLVTSSQ KNYLAWYQQKPQQSPKLLIYWASTRESGVPDRFTG SGSGTDFTLTITSVKADDLAVYYCQQYYAYPWTFG DGTKLEIKRTVAAPDIQMTQSPSSLSASVGDRVTI TCQASQDISNYLNWYQQKPGKAPKLLIYDASNLET GVPSRFSGSGSGTDFTFTISSLQPEDIATYFCQHF DHLPLAFGGGTKVEIKR |

Example 2.53

Generation of EGFR (Seq. 1) and VEGF (Seq. 1) DVD-Igs

TABLE 85

| DVD SEQ ID NO | Outer Variable Domain Name | Inner Variable Domain Name | Sequence 123456789012345678901234567890123456 |
|---|---|---|---|
| 307 | DVD093H | AB003VH | AB014VH | QVQLQESGPGLVKPSETLSLTCTVSGGSVSSGDYY WTWIRQSPGKGLEWIGHIYYSGNTNYNPSLKSRLT ISIDTSKTQFSLKLSSVTAADTAIYYCVRDRVTGA FDIWGQGTMVTVSSASTKGPEVQLVESGGGLVQPG GSLRLSCAASGYTFTNYGMNWVRQAPGKGLEWVGW INTYTGEPTYAADFKRRFTFSLDTSKSTAYLQMNS LRAEDTAVYYCAKYPHYYGSSHWYFDVWGQGTLVT VSS |
| 308 | DVD093L | AB003VL | AB014VL | DIQMTQSPSSLSASVGDRVTITCQASQDISNYLNW YQQKPGKAPKLLIYDASNLETGVPSRFSGSGSGTD FTFTISSLQPEDIATYFCQHFDHLPLAFGGGTKVE IKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |
| 309 | DVD094H | AB014VH | AB003VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLQESGPGL VKPSETLSLTCTVSGGSVSSGDYYWTIRQSPGKG LEWIGHIYYSGNTNYNPSLKSRLTISIDTSKTQFS LKLSSVTAADTAIYYCVRDRVTGAFDIWGQGTMVT VSS |
| 310 | DVD094L | AB014VL | AB003VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSPSSLSASVGDRVTITCQASQ DISNYLNWYQQKPGKAPKLLIYDASNLETGVPSRF SGSGSGTDFTFTISSLQPEDIATYFCQHFDHLPLA FGGGTKVEIKR |

Example 2.54

Generation of NRP1 (Seq. 2) and VEGF (Seq. 1) DVD-Igs

TABLE 86

| DVD SEQ ID NO | DVD Variable Domain Name | Outer Variable Domain Name | Inner Variable Domain Name | Sequence 123456789012345678901234567890123456789012345 |
|---|---|---|---|---|
| 311 | DVD107H | AB035VH | AB014VH | EVQLVESGGGLVQRGGSLRLSCAASGFTFSSYAMS WVRQAPGKGLEWVSQISPAGGYTNYADSVKGRFTI SADTSKNTAYLQMNSLRAEDTAVYYCARELRYYRM SKVMDVQGQGTLVTVSSASTKGPEVQLVESGGGLV QPGGSLRLSCAASGYTFTNYGMNWVRQAPGKGLEW VGWINTYTGEPTYAADFKRRFTFSLDTSKSTAYLQ MNSLRAEDTAVYYCAKYPHYYGSSHWYFDVWGQGT LVTVSS |
| 312 | DVD107L | AB035VL | AB014VL | DIQMTQSPSSLSASVGDRVTITCRASQYFSSYLAW YQQKPGKAPKLLIYGASSRASGVPSRFSGSGSGTD FTLTISSLQPEDFATYYCQQYLGSPPTFGQGTKVE IKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |
| 313 | DVD108H | AB014VH | AB035VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPEVQLVESGGGL VQPGGSLRLSCAASGFTFSSYAMSWVRQAPGKGLE WVSQISPAGGYTNYADSVKGRFTISADTSKNTAYL QMNSLRAEDTAVYYCARELPYYRMSKVMDVQGQGT LVTVSS |
| 314 | DVD108L | AB014VL | AB035VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSPSSLSASVGDRVTITCRASQ YFSSYLAWYQQKPGKAPKLLIYGASSRASGVPSRF SGSGSGTDFTLTISSLQPEDFATYYCQQYLGSPPT FGQGTKVEIKR |

Example 2.55

Generation of CD3 (Seq. 2) and CD-20 DVD-Igs

TABLE 87

| DVD SEQ ID NO | DVD Variable Domain Name | Outer Variable Domain Name | Inner Variable Domain Name | Sequence 123456789012345678901234567890123456789012345 |
|---|---|---|---|---|
| 315 | DVD131H | AB039VH | AB001VH | QVQLQQSGAELARPGASVKMSCKASGYTFTRYTMH WVKQRPGQGLEWIGYINPSRGYTNYNQKFKDKATL TTDKSSSTAYMQLSSLTSEDSAVYYCARYYDDHYC LDYWGQGTTLTVSSASTKGPQVQLQQPGAELVKPG ASVKMSCKASGYTFTSYNMHWVKQTPGRGLEWIGA IYPGNGDTSYNQKFKGKATLTADKSSSTAYMQLSS LTSEDSAVYYCARSTYYGGDWYFNVWGAGTTVTVSA |
| 316 | DVD131L | AB039VL | AB001VL | QIVLTQSPAIMSASPGEKVTMTCSASSSVSYMNWY QQKSGTSPKRWIYDTSKLASGVPAHFRGSGSGTSY SLTISGMEAEDAATYYCQQWSSNPFTFGSGTKLEI NRTVAAPQIVLSQSPAILSPSPGEKVTMTCRASSS VSYIHWFQQKPGSSPKPWIYATSNLASGVPVRFSG SGSGTSYSLTISRVEAEDAATYYCQQWTSNPPTFG GGTKLEIKR |
| 317 | DVD132H | AB001VH | AB039VH | QVQLQQPGAELVKPGASVKMSCKASGYTFTSYNMH WVKQTPGRGLEWIGAIYPGNGDTSYNQKFKGKATL TADKSSSTAYMQLSSLTSEDSAVYYCARSTYYGGD |

TABLE 87-continued

| DVD SEQ ID NO | Outer Variable Domain Name | Inner Variable Domain Name | Sequence 123456789012345678901234567890123456789012345 |
|---|---|---|---|
| | | | WYFNVWGAGTTVTVSAASTKGPQVQLQQSGAELAR PGASVKMSCKASGYTFTRYTMHWVKQRPGQGLEWI GYINPSRGYTNYNQKFKDKATLTTDKSSSTAYMQL SSLTSEDSAVYYCARYYDDHYCLDYWGQGTTLTVSS |
| 318 DVD132L | AB001VL | AB039VL | QIVLSQSPAILSPSPGEKVTMTCRASSSVSYIHWF QQKPGSSPKPWIYATSNLASGVPVRFSGSGSGTSY SLTISRVEAEDAATYYCQQWTSNPPTFGGGTKLEI KRTVAAPQIVLTQSPAIMSASPGEKVTMTCSASSS VSYMNWYQQKSGTSPKRWIYDTSKLASGVPAHFRG SGSGTSYSLTISGMEAEDAATYYCQQWSSNPFTFG SGTKLEINR |

Example 2.56

Generation of CD-3 (Seq. 2) and HER-2 (Seq. 1) DVD-Igs

TABLE 88

| DVD SEQ ID NO | Outer Variable Domain Name | Inner Variable Domain Name | Sequence 123456789012345678901234567890123456789012345 |
|---|---|---|---|
| 319 DVD135H | AB039VH | AB004VH | QVQLQQSGAELARPGASVKMSCKASGYTFTRYTMH WVKQRRGQGLEWIGYINPSRGYTNYNQKFKDKATL TTDKSSSTAYMQLSSLTSEDSAVYYCARYYDDHYC LDYWGQGTTLTVSSASTKGPEVQLVESGGGLVQPG GSLRLSCAASGFNIKDTYIHWVRQAPGKGLEWVAR IYPTNGYTRYADSVKGRFTISADTSKNTAYLQMNS LRAEDTAVYYCSRWGGDGFYAMDYWGQGTLVTVSS |
| 320 DVD135L | AB039VL | AB004VL | QIVLTQSPAIMSASPGEKVTMTCSASSSVSYMNWY QQKSGTSPKRWIYDTSKLASGVPAHFRGSGSGTSY SLTISGMEAEDAATYYCQQWSSNPFTFGSGTKLEI NRTVAAPDIQMTQSPSSLSASVGDRVTITCRASQD VNTAVAWYQQKPGKAPKLLIYSASFLYSGVPSRFS GSRSGTDFTLTISSLQPEDFATYYCQQHYTTPPTF GQGTKVEIKR |
| 321 DVD136H | AB004VH | AB039VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPQVQLQQSGAELARP GASVKMSCKASGYTFTRYTMHWVKQRPGQGLEWIG YINPSRGYTNYNQKFKDKATLTTDKSSSTAYMQLS SLTSEDSAVYYCARYYDDHYCLDYWGQGTTLTVSS |
| 322 DVD136L | AB004VL | AB039VL | DIQMTQSPSSLSASVGDRVTITCRASQDVNTAVAW YQQKPGKAPKLLIYSASFLYSGVRSRFSGSRSGTD FTLTISSLQPEDFATYYCQQHYTTPPTFGQGTKVE IKRTVAAPQIVLTQSPAIMSASPGEKVTMTCSASS SVSYMNWYQQKSGTSPKRWIYDTSKLASGVPAHFR GSGSGTSYSLTISGMEAEDAATYYCQQWSSNPFTF GSGTKLEINR |

Example 2.57

Generation of CD-3 (Seq. 2) and CD-19 DVD-Igs

TABLE 89

| DVD SEQ ID NO | DVD Variable Domain Name | Outer Variable Domain Name | Inner Variable Domain Name | Sequence |
|---|---|---|---|---|
| 323 | DVD137H | AB039VH | AB006VH | QVQLQQSGAELARPGASVKMSCKASGYTFTRYTMH WVKQRPGQGLEWIGYINPSRGYTNYNQKFKDKATL TTDKSSSTAYMQLSSLTSEDSAVYYCARYYDDHYC LDYWGQGTTLTVSSASTKGPQVQLQQSGAELVRPG SSVKISCKASGYAFSSYWMNWVKQRPGQGLEWIGQ IWPGDGDTNYNGKFKGKATLTADESSSTAYMQLSS LASEDSAVYFCARRETTTVGRYYYAMDYWGQGTSV TVSS |
| 324 | DVD137L | AB039VL | AB006VL | QIVLTQSPAIMSASPGEKVTMTCSASSSVSYMNWY QQKSGTSPKRWIYDTSKLASGVPAHFRGSGSGTSY SLTISGMEAEDAATYYCQQWSSNPFTFGSGTKLEI NRTVAAPDILLTQTPASLAVSLGQRATISCKASQS VDYDGDSYLNWYQQIPGQPPKLLIYDASNLVSGIP PRFSGSGSGTDFTLNIHPVEKVDAATYHCQQSTED PWTFGGGTKLEIKR |
| 325 | DVD138H | AB006VH | AB039VH | QVQLQQSGAELVRPGSSVKISCKASGYAFSSYWMN WVKQRPGQGLEWIGQIWPGDGDTNYNGKFKGKATL TADESSSTAYMQLSSLASEDSAVYFCARRETTTVG RYYYAMDYWGQGTSVTVSSASTKGPQVQLQQSGAE LARPGASVKMSCKASGYTFTRYTMHWVKQRRGQGL EWIGYINPSRGYTNYNQKFKDKATLTTDKSSSTAY MQLSSLTSEDSAVYYCARYYDDHYCLDYWGQGTTL TVSS |
| 326 | DVD138L | AB006VL | AB039VL | DILLTQTPASLAVSLGQRATISCKASQSVDYDGDS YLNWYQQIPGQPPKLLIYDASNLVSGIPPRFSGSG SGTDFTLNIHPVEKVDAATYHCQQSTEDPWTFGGG TKLEIKRTVAAPQIVLTQSPAIMSASPGEKVTMTC SASSSVSYMNWYQQKSGTSPKRWIYDTSKLASGVP AHFRGSGSGTSYSLTISGMEAEDAATYYCQQWSSN PFTFGSGTKLEINR |

Example 2.58

Generation of CD-3 (Seq. 2) and EGFR (Seq. 2) DVD-Igs

TABLE 90

| DVD SEQ ID NO | DVD Variable Domain Name | Outer Variable Domain Name | Inner Variable Domain Name | Sequence |
|---|---|---|---|---|
| 327 | DVD139H | AB039VH | AB033VH | QVQLQQSGAELARPGASVKMSCKASGYTFTRYTMH WVKQRPGQGLEWIGYINPSRGYTNYNQKFKDKATL TTDKSSSTAYMQLSSLTSEDSAVYYCARYYDDHYC LDYWGQGTTLTVSSASTKGPQVQLKQSGPGLVQPS QSLSITCTVSGFSLTNYGVHWVRQSPGKGLEWLGV IWSGGNTDYNTPFTSRLSINKDNSKSQVFFKMNSL QSNDTAIYYCARALTYYDYEFAYWGQGTLVTVSA |
| 328 | DVD139L | AB039VL | AB033VL | QIVLTQSPAIMSASPGEKVTMTCSASSSVSYMNWY QQKSGTSPKRWIYDTSKLASGVPAHFRGSGSGTSY SLTISGMEAEDAATYYCQQWSSNPFTFGSGTKLEI NRTVAAPDILLTQSPVILSVSPGERVSFSCRASQS IGTNIHWYQQRTNGSPRLLIKYASESISGIPSRFS GSGSGTDFTLSINSVESEDIADYYCQQNNNWPTTF GAGTKLELKR |
| 329 | DVD140H | AB033VH | AB039VH | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE |

TABLE 90-continued

| DVD SEQ ID NO | Outer Variable Domain Name | Inner Variable Domain Name | Sequence 123456789012345678901234567890123456789012345 |
|---|---|---|---|
| | | | FAYWGQGTLVTVSAASTKGPQVQLQQSGAELARPG ASVKMSCKASGYTFTRYTMHWVKQRPGQGLEWIGY INPSRGYTNYNQKFKDKATLTTDKSSSTAYMQLSS LTSEDSAVYYCARYYDDHYCLDYWGQGTTLTVSS |
| 330 DVD140L | AB033VL | AB039VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPQIVLTQSPAIMSASPGEKVTMTCSASS SVSYMNWYQQKSGTSPKRWIYDTSKLASGVPAHFR GSGSGTSYSLTISGMEAEDAATYYCQQWSSNPFTF GSGTKLEINR |

Example 2.59

Generation of CD-3 (Seq. 2) and EGFR (Seq. 1) DVD-Igs

TABLE 91

| DVD SEQ ID NO | Outer Variable Domain Name | Inner Variable Domain Name | Sequence 123456789012345678901234567890123456789012345 |
|---|---|---|---|
| 331 DVD141H | AB039VH | AB003VH | QVQLQQSGAELARPGASVKMSCKASGYTFTRYTMH WVKQRPGQGLEWIGYINPSRGYTNYNQKFKDKATL TTDKSSSTAYMQLSSLTSEDSAVYYCARYYDDHYC LDYWGQGTTLTVSSASTKGPQVQLQESGPGLVKPS ETLSLTCTVSGGSVSSGDYYWTWIRQSPGKGLEWI GHIYYSGNTNYNPSLKSRLTISIDTSKTQFSLKLS SVTAADTAIYYCVRDRVTGAFDIWGQGTMVTVSS |
| 332 DVD141L | AB039VL | AB003VL | QIVLTQSPAIMSASPGEKVTMTCSASSSVSYMNWY QQKSGTSPKRWIYDTSKLASGVPAHFRGSGSGTSY SLTISGMEAEDAATYYCQQWSSNPFTFGSGTKLEI NRTVAAPDIQMTQSPSSLSASVGDRVTITCQASQD ISNYLNWYQQKPGKAPKLLIYDASNLETGVPSRFS GSGSGTDFTFTISSLQPEDIATYFCQHFDHLPLAF GGGTKVEIKR |
| 333 DVD142H | AB003VH | AB039VH | QVQLQESGPGLVKPSETLSLTCTVSGGSVSSGDYY WTWIRQSPGKGLEWIGHIYYSGNTNYNPSLKSRLT ISIDTSKTQFSLKLSSVTAADTAIYYCVRDRVTGA FDIWGQGTMVTVSSASTKGPQVQLQQSGAELARPG ASVKMSCKASGYTFTRYTMHWVKQRPGQGLEWIGY INPSRGYTNYNQKFKDKATLTTDKSSSTAYMQLSS LTSEDSAVYYCARYYDDHYCLDYWGQGTTLTVSS |
| 334 DVD142L | AB003VL | AB039VL | DIQMTQSPSSLSASVGDRVTITCQASQDISNYLNW YQQKPGKAPKLLIYDASNLETGVPSRFSGSGSGTD FTFTISSLQPEDIATYFCQHFDHLPLAFGGGTKVE IKRTVAAPQIVLTQSPAIMSASPGEKVTMTCSASS SVSYMNWYQQKSGTSPKRWIYDTSKLASGVPAHFR GSGSGTSYSLTISGMEAEDAATYYCQQWSSNPFTF GSGTKLEINR |

Example 2.60

Generation of EGFR (Seq. 1) and IGF1,2 DVD-Igs

TABLE 92

| DVD SEQ ID NO | DVD Variable Domain Name | Outer Variable Domain Name | Inner Variable Domain Name | Sequence 12345678901234567890123456789012345 |
|---|---|---|---|---|
| 335 | DVD143H | AB003VH | AB010VH | QVQLQESGPGLVKPSETLSLTCTVSGGSVSSGDYY WTWIRQSPGKGLEWIGHIYYSGNTNYNRSLKSRLT ISIDTSKTQFSLKLSSVTAADTAIYYCVRDRVTGA FDIWGQGTMVTVSSASTKGPQVQLVQSGAEVKKPG ASVKVSCKASGYTFTSYDINWVRQATGQGLEWMGW MNPNSGNTGYAQKFQGRVTMTRNTSISTAYMELSS LRSEDTAVYYCARDPYYYYYGMDVWGQGTTVTVSS |
| 336 | DVD143L | AB003VL | AB010VL | DIQMTQSPSSLSASVGDRVTITCQASQDISNYLNW YQQKPGKAPKLLIYDASNLETGVPSRFSGSGSGTD FTFTISSLQPEDIATYFCQHFDHLPLAFGGGTKVE IKRTVAAPQSVLTQPPSVSAAPGQKVTISCSGSSS NIENNHVSWYQQLPGTAPKLLIYDNNKRPSGIPDR FSGSKSGTSATLGITGLQTGDEADYYCETWDTSLS AGRVFGGGTKLTVLG |
| 337 | DVD144H | AB010VH | AB003VH | QVQLVQSGAEVKKPGASVKVSCKASGYTFTSYDIN WVRQATGQGLEWMGWMNPNSGNTGYAQKFQGRVTM TRNTSISTAYMELSSLRSEDTAVYYCARDPYYYYY GMDVWGQGTTVTVSSASTKGPQVQLQESGPGLVKP SETLSLTCTVSGGSVSSGDYYWTWIRQSPGKGLEW IGHIYYSGNTNYNPSLKSRLTISIDTSKTQFSLKL SSVTAADTAIYYCVRDRVTGAFDIWGQGTMVTVSS |
| 338 | DVD144L | AB010VL | AB003VL | QSVLTQPPSVSAAPGQKVTISCSGSSSNIENNHVS WYQQLPGTAPKLLIYDNNKRPSGIPDRFSGSKSGT SATLGITGLQTGDEADYYCETWDTSLSAGRVFGGG TKLTVLGQPKAAPDIQMTQSPSSLSASVGDRVTIT CQASQDISNYLNWYQQKPGKAPKLLIYDASNLETG VPSRFSGSGSGTDFTFTISSLQPEDIATYFCQHFD HLPLAFGGGTKVEIKR |

Example 2.61

Generation of DLL-4 (Seq. 1) and PLGF (Seq. 1) DVD-Igs

TABLE 93

| DVD SEQ ID NO | DVD Variable Domain Name | Outer Variable Domain Name | Inner Variable Domain Name | Sequence 12345678901234567890123456789012345 |
|---|---|---|---|---|
| 339 | VD257H | AB015VH | AB047VH | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPQVQLQQSGAELVKPGA SVKISCKASGYTFTDYYINWVKLAPGQGLEWIGWI YRGSGNTKYNEKFKGKATLTIDTSSSTAYMQLSSL TSEDTAVYFCVRDSPFFDYWGQGTLLTVSS |
| 340 | VD257L | AB015VL | AB047VL | DIQMTQSPSSLSASVGDRVTITCRASQDVSTAVAW YQQKPGKAPKLLIYSASFLYSGVPSRFSGSGSGTD FTLTISSLQPEDFATTYYCQQSYTGTVTFGQGTKV EIKRTVAAPDIVLTQSPDSLAVSLGERVTMNCKSS QSLLNSGMRKSFLAWYQQKPGQSPKLLIYWASTRE SGVPDRFTGSGSGTDFTLTISSVQAEDVAVYYCKQ SYHLFTFGSGTKLEIKR |
| 341 | VD258H | AB047VH | AB015VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPEVQLVESGGGLVQPGGSL RLSCAASGFTFTDNWISWVRQAPGKGLEWVGYISP |

TABLE 93-continued

| DVD SEQ ID NO | Outer Variable Domain Name | Inner Variable Domain Name | Sequence 123456789012345678901234567890123456789012345 |
|---|---|---|---|
| | | | NSGFTYYADSVKGRFTISADTSKNTAYLQMNSLRA EDTAVYYCARDNFGGYFDYWGQGTLVTVSS |
| 342 VD258L | AB047VL | AB015VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPDIQMTQSPSSLSASVGDRVTIT CRASQDVSTAVAWYQQKPGKAPKLLIYSASFLYSG VPSRFSGSGSGTDFTLTISSLQPEDFATTYYCQQS YTGTVTFGQGTKVEIKR |

Example 2.62

Generation of VEGF (Seq. 1) and PLGF (Seq. 1) DVD-Igs with Linker Set 1

TABLE 94

| DVD SEQ ID NO | Outer Variable Domain Name | Inner Variable Domain Name | Sequence 123456789012345678901234567890123456789012345 |
|---|---|---|---|
| 343 VD259H | AB014VH | AB047VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLQQSGAEL VKPGASVKISCKASGYTFTDYYINWVKLAPGQGLE WIGWIYPGSGNTKYNEKFKGKATLTIDTSSSTAYM QLSSLTSEDTAVYFCVRDSPFFDYWGQGTLLTVSS |
| 344 VD259L | AB014VL | AB047VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIVLTQSPDSLAVSLGERVTMNCKSSQ SLLNSGMRKSFLAWYQQKPGQSPKLLIYWASTRES GVPDRFTGSGSGTDFTLTISSVQAEDVAVYYCKQS YHLFTFGSGTKLEIKR |
| 345 VD260H | AB047VH | AB014VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPEVQLVESGGGLVQPGGSL RLSCAASGYTFTNYGMNWVRQAPGKGLEWVGWINT YTGEPTYAADFKRRFTFSLDTSKSTAYLQMNSLRA EDTAVYYCAKYPHYYGSSHWYFDVWGQGTLVTVSS |
| 346 VD260L | AB047VL | AB014VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPDIQMTQSPSSLSASVGDRVTIT CSASQDISNYLNWYQQKPGKAPKVLIYFTSSLHSG VPSRFSGSGSGTDFTLTISSLQPEDFATYYCQQYS TVPWTFGQGTKVEIKR |

Example 2.63

Generation of VEGF (Seq. 1) and PLGF (Seq. 1)
DVD-Igs with Linker Set 2

TABLE 95

| DVD SEQ ID NO | Outer Variable Domain Name | Inner Variable Domain Name | Sequence 123456789012345678901234567890123456789012345 |
|---|---|---|---|
| 347 | DVD579H AB047VH | AB014VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPSVFPLAPEVQLVESGGGL VQPGGSLRLSCAASGYTFTNYGMNWVRQAPGKGLE WVGWINTYTGEPTYAADFKRRFTFSLDTSKSTAYL QMNSLRAEDTAVYYCAKYPHYYGSSHWYFDVWGQG TLVTVSS |
| 348 | DVD579L AB047VL | AB014VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPSVFIFPPDIQMTQSPSSLSASV GDRVTITCSASQDISNYLNWYQQKPGKAPKVLIYF TSSLHSGVPSRFSGSGSGTDFTLTISSLQPEDFAT YYCQQYSTVPWTFGQGTKVEIKR |
| 349 | DVD580H AB014VH | AB047VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPQVQL QQSGAELVKPGASVKISCKASGYTFTDYYINWVKL APGQGLEWIGWIYPGSGNTKYNEKFKGKATLTIDT SSSTAYMQLSSLTSEDTAVYFCVRDSPFFDYWGQG TLLTVSS |
| 350 | DVD580L AB014VL | AB047VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPDIVLTQSPDSLAVSLGERVT MNCKSSQSLLNSGMRKSFLAWYQQKPGQSPKLLIY WASTRESGVPDRFTGSGSGTDFTLTISSVQAEDVA VYYCKQSYHLFTFGSGTKLEIKR |

Example 2.64

Generation of VEGF (Seq. 1) and PLGF (Seq. 1)
DVD-Igs with Linker Set 3

TABLE 96

| DVD SEQ ID NO | Outer Variable Domain Name | Inner Variable Domain Name | Sequence 123456789012345678901234567890123456789012345 |
|---|---|---|---|
| 351 | DVD587VH AB047VH | AB014VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPSVFPLAPEVQLVESGGGL VQPGGSLRLSCAASGYTFTNYGMNWVRQAPGKGLE WVGWINTYTGEPTYAADFKRRFTFSLDTSKSTAYL QMNSLRAEDTAVYYCAKYPHYYGSSHWYFDVWGQG TLVTVSS |
| 352 | DVD587VL AB047VL | AB014VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPDIQMTQSPSSLSASVGDRVTIT CSASQDISNYLNWYQQKPGKAPKVLIYFTSSLHSG VPSRFSGSGSGTDFTLTISSLQPEDFATYYCQQYS TVPWTFGQGTKVEIKR |

TABLE 96-continued

| DVD SEQ ID NO | Outer Variable Domain Name | Inner Variable Domain Name | Sequence 123456789012345678901234567890123456789012345 |
|---|---|---|---|
| 353 | DVD588VH AB014VH | AB047VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPQVQL QQSGAELVKPGASVKISCKASGYTFTDYYINWVKL APGQGLEWIGWIYPGSGNTKYNEKFKGKATLTIDT SSSTAYMQLSSLTSEDTAVYFCVRDSPFFDYWGQG TLLTVSS |
| 354 | DVD588VL AB014VL | AB047VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIVLTQSPDSLAVSLGERVTMNCKSSQ SLLNSGMRKSFLAWYQQKPGQSPKLLIYWASTRES GVPDRFTGSGSGTDFTLTISSVQAEDVAVYYCKQS YHLFTFGSGTKLEIKR |

Example 2.65

Generation of VEGF (Seq. 1) and PLGF (Seq. 1) DVD-Igs with Linker Set 4

TABLE 97

| DVD SEQ ID NO | Outer Variable Domain Name | Inner Variable Domain Name | Sequence 123456789012345678901234567890123456789012345 |
|---|---|---|---|
| 355 | DVD595VH AB047VH | AB014VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPEVQLVESGGGLVQPGGSL RLSCAASGYTFTNYGMNWVRQAPGKGLEWVGWINT YTGEPTYAADFKRRFTFSLDTSKSTAYLQMNSLRA EDTAVYYCAKYPHYYGSSHWYFDVWGQGTLVTVSS |
| 356 | DVD595VL AB047VL | AB014VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPSVFIFPPDIQMTQSPSSLSASV GDRVTITCSASQDISNYLNWYQQKPGKAPKVLIYF TSSLHSGVPSRFSGSGSGTDFTLTISSLQPEDFAT YYCQQYSTVPWTFGQGTKVEIKR |
| 357 | DVD596VH AB014VH | AB047VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLQQSGAEL VKPGASVKISCKASGYTFTDYYINWVKLAPGQGLE WIGWIYPGSGNTKYNEKFKGKATLTIDTSSSTAYM QLSSLTSEDTAVYFCVRDSPFFDYWGQGTLLTVSS |
| 358 | DVD596VL AB014VL | AB047VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPDIVLTQSPDSLAVSLGERVT MNCKSSQSLLNSGMRKSFLAWYQQKPGQSPKLLIY WASTRESGVPDRFTGSGSGTDFTLTISSVQAEDVA VYYCKQSYHLFTFGSGTKLEIKR |

Example 2.66

Generation of EGFR (Seq. 2) and ErbB3 (Seq. 1)
DVD-Igs with Linker Set 1

TABLE 98

| DVD SEQ ID NO | Outer Variable Domain Name | Inner Variable Domain Name | Sequence 123456789012345678901234567890123456789012345 |
|---|---|---|---|
| 359 | VD299H | AB062VH | AB033VH | QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA |
| 360 | VD299L | AB062VL | AB033VL | DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPDILLTQSRVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR |
| 361 | VD300H | AB033VH | AB062VH | QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPQVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSS |
| 362 | VD300L | AB033VL | AB062VL | DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDIEMIQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKR |

Example 2.67

Generation of EGFR (Seq. 2) and ErbB3 (Seq. 1)
DVD-Igs with Linker Set 2

TABLE 99

| DVD SEQ ID NO | Outer Variable Domain Name | Inner Variable Domain Name | Sequence 123456789012345678901234567890123456789012345 |
|---|---|---|---|
| 363 | DVD385H | AL062 | AL033 | QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPSVFPLAPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA |
| 364 | DVD385L | AL062 | AL033 | DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPSVFIFPPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR |
| 365 | DVD386H | AL033 | AL062 | QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYE |

TABLE 99-continued

| DVD SEQ ID NO | DVD Variable Domain Name | Outer Variable Domain Name | Inner Variable Domain Name | Sequence 123456789012345678901234567890123456 |
|---|---|---|---|---|
| | | | | FAYWGQGTLVTVSAASTKGPSVFPLAPQVQLQQWG AGLLKPSETLSLTCAVYGGSFSGYYWSWIRQPPGK GLEWIGEINHSGSTNYNPSLKSRVTISVETSKNQF SLKLSSVTAADTAVYYCARDKWTWYFDLWGRGTLV TVSS |
| 366 | DVD386L | AL033 | AL062 | DILLTQSPVILSVSRGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPSVFIFPPDIEMTQSPDSLAVSLGERAT INCRSSQSVLYSSSNRNYLAWYQQNPGQPPKLLIY WASTRESGVPDRFSGSGSGTDFTLTISSLQAEDVA VYYCQQYYSTPRTFGQGTKVEIKR |

Example 2.68

Generation of EGFR (Seq. 2) and ErbB3 (Seq. 1) DVD-Igs with Linker Set 3

TABLE 100

| DVD SEQ ID NO | DVD Variable Domain Name | Outer Variable Domain Name | Inner Variable Domain Name | Sequence 123456789012345678901234567890123456 |
|---|---|---|---|---|
| 367 | DVD389H | AL062 | AL033 | QVQLQQWGAGLLKPSETLSLTCAVYGGSFSGYYWS WIRQPPGKGLEWIGEINHSGSTNYNPSLKSRVTIS VETSKNQFSLKLSSVTAADTAVYYCARDKWTWYFD LWGRGTLVTVSSASTKGPSVFPLAPQVQLKQSGPG LVQPSQSLSITCTVSGFSLTNYGVHWVRQSPGKGL EWLGVIWSGGNTDYNTPFTSRLSINKDNSKSQVFF KMNSLQSNDTAIYYCARALTYYDYEFAYWGQGTLV TVSA |
| 368 | DVD389L | AL062 | AL033 | DIEMTQSPDSLAVSLGERATINCRSSQSVLYSSSN RNYLAWYQQNPGQPPKLLIYWASTRESGVPDRFSG SGSGTDFTLTISSLQAEDVAVYYCQQYYSTPRTFG QGTKVEIKRTVAAPDILLTQSPVILSVSPGERVSF SCRASQSIGTNIHWYQQRTNGSPRLLIKYASESIS GIPSRFSGSGSGTDFTLSINSVESEDIADYYCQQN NNWPTTFGAGTKLELKR |
| 369 | DVD390H | AL033 | AL062 | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPSVFPLAPQVQLQQWG AGLLKPSETLSLTCAVYGGSFSGYYWSWIRQPPGK GLEWIGEINHSGSTNYNPSLKSRVTISVETSKNQF SLKLSSVTAADTAVYYCARDKWTWYFDLWGRGTLV TVSS |
| 370 | DVD390L | AL033 | AL062 | DILLTQSPVILSVSRGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPDIEMTQSPDSLAVSLGERATINCRSSQ SVLYSSSNRNYLAWYQQNPGQPPKLLIYWASTRES GVPDRFSGSGSGTDFTLTISSLQAEDVAVYYCQQY YSTPRTFGQGTKVEIKR |

Example 2.69

Generation of EGFR (Seq. 2) and ErbB3 (Seq. 1)
DVD-Igs with Linker Set 4

TABLE 101

| DVD SEQ ID NO | DVD Variable Domain Name | Outer Variable Domain Name | Inner Variable Domain Name | Sequence 12345678901234567890123456789012345 |
|---|---|---|---|---|
| 371 | DVD393H | AL062 | AL033 | QVQLQQWGAGLLKPSETLSLTCAVYGGSFSGYYWS WIRQPPGKGLEWIGEINHSGSTNYNPSLKSRVTIS VETSKNQFSLKLSSVTAADTAVYYCARDKWTWYFD LWGRGTLVTVSSASTKGPQVQLKQSGPGLVQPSQS LSITCTVSGFSLTNYGVHWVRQSPGKGLEWLGVIW SGGNTDYNTPFTSRLSINKDNSKSQVFFKMNSLQS NDTAIYYCARALTYYDYEFAYWGQGTLVTVSA |
| 372 | DVD393L | AL062 | AL033 | DIEMTQSPDSLAVSLGERATINCRSSQSVLYSSSN RNYLAWYQQNPGQPPKLLIYWASTRESGVPDRFSG SGSGTDFTLTISSLQAEDVAVYYCQQYYSTPRTFG QGTKVEIKRTVAAPSVFIFPPDILLTQSPVILSVS PGERVSFSCRASQSIGTNIHWYQQRTNGSPRLLIK YASESISGIPSRFSGSGSGTDFTLSINSVESEDIA DYYCQQNNNWPTTFGAGTKLELKR |
| 373 | DVD394H | AL033 | AL062 | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPQVQLQQWGAGLLKPS ETLSLTCAVYGGSFSGYYWSWIRQPPGKGLEWIGE INHSGSTNYNPSLKSRVTISVETSKNQFSLKLSSV TAADTAVYYCARDKWTWYFDLWGRGTLVTVSS |
| 374 | DVD394L | AL033 | AL062 | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPSVFIFPPDIEMTQSPDSLAVSLGERAT INCRSSQSVLYSSSNRNYLAWYQQNPGQPPKLLIY WASTRESGVPDRFSGSGSGTDFTLTISSLQAEDVA VYYCQQYYSTPRTFGQGTKVEIKR |

Example 2.70

Generation of EGFR (Seq. 1) and ErbB3 (Seq. 1)
DVD-Igs

TABLE 102

| DVD SEQ ID NO | DVD Variable Domain Name | Outer Variable Domain Name | Inner Variable Domain Name | Sequence 12345678901234567890123456789012345 |
|---|---|---|---|---|
| 375 | DVD301H | AB062VH | AB003VH | QVQLQQWGAGLLKPSETLSLTCAVYGGSFSGYYWS WIRQPPGKGLEWIGEINHSGSTNYNPSLKSRVTIS VETSKNQFSLKLSSVTAADTAVYYCARDKWTWYFD LWGRGTLVTVSSASTKGPQVQLQESGPGLVKPSET LSLTCTVSGGSVSSGDYYWTWIRQSRPKGLEWIGH IYYSGNTNYNPSLKSRLTISIDTSKTQFSLKLSSV TAADTAIYYCVRDRVTGAFDIWGQGTMVTVSS |
| 376 | DVD301L | AB062VL | AB003VL | DIEMTQSPDSLAVSLGERATINCRSSQSVLYSSSN RNYLAWYQQNPGQPPKLLIYWASTRESGVPDRFSG SGSGTDFTLTISSLQAEDVAVYYCQQYYSTPRTFG QGTKVEIKRTVAAPDIQMTQSPSSLSASVGDRVTI TCQASQDISNYLNWYQQKPGKAPKLLIYDASNLET GVPSRFSGSGSGTDFTFTISSLQPEDIATYFCQHF DHLPLAFGGGTKVEIKR |
| 377 | DVD302H | AB003VH | AB062VH | QVQLQESGPGLVKPSETLSLTCTVSGGSVSSGDYY WTWIRQSPGKGLEWIGHIYYSGNTNYNPSLKSRLT ISIDTSKTQFSLKLSSVTAADTAIYYCVRDRVTGA FDIWGQGTMVTVSSASTKGPQVQLQQWGAGLLKPS |

TABLE 102-continued

| DVD SEQ ID NO | Outer Variable Domain Name | Inner Variable Domain Name | Sequence 123456789012345678901234567890123456 |
|---|---|---|---|
| | | | ETLSLTCAVYGGSFSGYYWSWIRQPPGKGLEWIGE INHSGSTNYNPSLKRVTISVETSKNQFSLKLSSV TAADTAVYYCARDKWTWYFDLWGRGTLVTVSS |
| 378 DVD302L | AB003VL | AB062VL | DIQMTQSPSSLSASVGDRVTITCQASQDISNYLNW YQQKPGKAPKLLIYDASNLETGVPSRFSGSGSGTD FTFTISSLQPEDIATYFCQHFDHLPLAFGGGTKVE IKRTVAAPDIEMTQSPDSLAVSLGERATINCRSSQ SVLYSSSNRNYLAWYQQNPGQPPKLLIYWASTRES GVPDRFSGSGSGTDFTLTISSLQAEDVAVYYCQQY YSTPRTFGQGTKVEIKR |

Example 2.71

Generation of HGF (Seq. 1) and ErbB3 (Seq. 1) DVD-Igs

TABLE 103

| DVD SEQ ID NO | Outer Variable Domain Name | Inner Variable Domain Name | Sequence 123456789012345678901234567890123456 |
|---|---|---|---|
| 379 DVD303H | AB062VH | AB012VH | QVQLQQWGAGLLKPSETLSLTCAVYGGSFSGYYWS WIRQPPGKGLEWIGEINHSGSTNYNPSLKRVTIS VETSKNQFSLKLSSVTAADTAVYYCARDKWTWYFD LWGRGTLVTVSSASTKGPQVQLVESGGGLVKPGGS LRLSCAASGFTFSDYYMSWIRQAPGKGLEWVSYIS SSGSTIYYADSVKGRFTISRDNAKNSLYLQMNSLR AFDTAVYYCARDEYNSGWYVLFDYWGQGTLVTVSS |
| 380 DVD303L | AB062VL | AB012VL | DIEMTQSPDSLAVSLGERATINCRSSQSVLYSSSN RNYLAWYQQNPGQPPKLLIYWASTRESGVPDRFSG SGSGTDFTLTISSLQAEDVAVYYCQQYYSTPRTFG QGTKVEIKRTVAAPDIQMTQSPSSVSASVGDRVTI TCRASQGISSWLAWYQQKPGKAPNLLIYEASSLQS GVPSRFGGSGSGTDFTLTISSLQPEDFATYYCQQA NGFPWTFGQGTKVEIKR |
| 381 DVD304H | AB012VH | AB062VH | QVQLVESGGGLVKPGGSLRLSCAASGFTFSDYYMS WIRQAPGKGLEWVSYISSSGSTIYYADSVKGRFTI SRDNAKNSLYLQMNSLRAEDTAVYYCARDEYNSGW YVLFDYWGQGTLVTVSSASTKGPQVQLQQWGAGLL KPSETLSLTCAVYGGSFSGYYWSWIRQPPGKGLEW IGEINHSGSTNYNPSLKRVTISVETSKNQFSLKL SSVTAADTAVYYCARDKWTWYFDLWGRGTLVTVSS |
| 382 DVD304L | AB012VL | AB062VL | DIQMTQSPSSVSASVGDRVTITCRASQGISSWLAW YQQKPGKAPNLLIYEASSLQSGVPSRFGGSGSGTD FTLTISSLQPEDFATYYCQQANGFPWTFGQGTKVE IKRTVAAPDIEMTQSPDSLAVSLGERATINCRSSQ SVLYSSSNRNYLAWYQQNPGQPPKLLIYWASTRES GVPDRFSGSGSGTDFTLTISSLQAEDVAVYYCQQY YSTPRTFGQGTKVEIKR |

Example 2.72

Generation of EGFR (Seq. 2) and ErbB3 (Seq. 2) DVD-Igs with Linker Set 1

TABLE 104

| DVD SEQ ID NO | DVD Variable Domain Name | Outer Variable Domain Name | Inner Variable Domain Name | Sequence 12345678901234567890123456789012345 |
|---|---|---|---|---|
| 383 | DVD305H | AB063VH | AB033VH | EVQLVESGGGLVQPGGSLRLSCAASGFTFSIYSMN WVRQAPGKGLEWVSYISSSSSTIYYADSVKGRFTI SRDNAKNSLYLQMNSLRDEDTAVYYCARDRGDFDA FDIWGQGTMVTVSSASTKGPQVQLKQSGPGLVQPS QSLSITCTVSGFSLTNYGVHWVRQSPGKGLEWLGV IWSGGNTDYNTPFTSRLSINKDNSKSQVFFKMNSL QSNDTAIYYCARALTYYDYEFAYWGQGTLVTVSA |
| 384 | DVD305L | AB063VL | AB033VL | DIQMTQSPSSLSASVGDRVTITCQASQDITNYLNW YQQKPGKAPKLLIYDASNLETGVPSRFSGSGSGTD FTFTISSLQPEDIATYNCQQCENFPITFGQGTRLE IKRTVAAPDILLTQSPVILSVSPGERVSFSCRASQ SIGTNIHWYQQRTNGSPRLLIKYASESISGIPSRF SGSGSGTDFTLSINSVESEDIADYYCQQNNNWPTT FGAGTKLELKR |
| 385 | DVD306H | AB033VH | AB063VH | QVQLKQSGRGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPEVQLVESGGGLVQPG GSLRLSCAASGFTFSIYSMNWVRQAPGKGLEWVSY ISSSSSTIYYADSVKGRFTISRDNAKNSLYLQMNS LRDEDTAVYYCARDRGDFDAFDIWGQGTMVTVSS |
| 386 | DVD306L | AB033VL | AB063VL | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPDIQMTQSPSSLSASVGDRVTITCQASQ DITNYLNWYQQKPGKAPKLLIYDASNLETGVPSRF SGSGSGTDFTFTISSLQPEDIATYNCQQCENFPIT FGQGTRLEIKR |

Example 2.73

Generation of EGFR (Seq. 2) and ErbB3 (Seq. 2) DVD-Igs with Linker Set 2

TABLE 105

| DVD SEQ ID NO | DVD Variable Domain Name | Outer Variable Domain Name | Inner Variable Domain Name | Sequence 12345678901234567890123456789012345 |
|---|---|---|---|---|
| 387 | DVD397H | AB063 | AB033 | EVQLVESGGGLVQPGGSLRLSCAASGFTFSIYSMN WVRQAPGKGLEWVSYISSSSSTIYYADSVKGRFTI SRDNAKNSLYLQMNSLRDEDTAVYYCARDRGDFDA EDIWGQGTMVTVSSASTKGPSVFPLAPQVQLKQSG PGLVQPSQSLSITCTVSGFSLTNYGVHWVRQSPGK GLEWLGVIWSGGNTDYNTPFTSRLSINKDNSKSQV FFKMNSLQSNDTAIYYCARALTYYDYEFAYWGQGT LVTVSA |
| 388 | DVD397L | AB063 | AB033 | DIQMTQSPSSLSASVGDRVTITCQASQDITNYLNW YQQKPGKAPKLLIYDASNLETGVPSRFSGSGSGTD FTFTISSLQPEDIATYNCQQCENFPITFGQGTRLE IKRTVAAPSVFIFPPDILLTQSPVILSVSPGERVS FSCRASQSIGTNIHWYQQRTNGSPRLLIKYASESI SGIPSRFSGSGSGTDFTLSINSVESEDIADYYCQQ NNNWPTTFGAGTKLELKR |
| 389 | DVD398H | AB033 | AB063 | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE |

TABLE 105-continued

| DVD SEQ ID NO | DVD Variable Domain Name | Outer Variable Domain Name | Inner Variable Domain Name | Sequence 123456789012345678901234567890123 45 |
|---|---|---|---|---|
| | | | | FAYWGQGTLVTVSAASTKGPSVFPLAPEVQLVESG GGLVQPGGSLRLSCAASGFTFSIYSMNWVRQAPGK GLEWVSYISSSSSTIYYADSVKGRFTISRDNAKNS LYLQMNSLRDEDTAVYYCARDRGDFDAFDIWGQGT MVTVSS |
| 390 | DVD398L | AB033 | AB063 | DILLTQSPVILSVSPGERVSFSCRASQSIGTNIHW YQQRTNGSPRLLIKYASESISGIPSRFSGSGSGTD FILSINSVESEDIADYYCQQNNNWPTTFGAGTKLE LKRTVAAPSVFIFPPDIQMTQSPSSLSASVGDRVT ITCQASQDITNYLNWYQQKPGKAPKLLIYDASNLE TGVPSRFSGSGSGTDFTFTISSLQPEDIATYNCQQ CENFPITFGQGTRLEIKR |

Example 2.74

Generation of EGFR (Seq. 2) and ErbB3 (Seq. 2) DVD-Igs with Linker Set 3

TABLE 106

| DVD SEQ ID NO | DVD Variable Domain Name | Outer Variable Domain Name | Inner Variable Domain Name | Sequence 123456789012345678901234567890123 45 |
|---|---|---|---|---|
| 391 | DVD401H | AB063 | AB033 | EVQLVESGGGLVQPGGSLRLSCAASGFTFSIYSMN WVRQAPGKGLEWVSYISSSSSTIYYADSVKGRFTI SRDNAKNSLYLQMNSLRDEDTAVYYCARDRGDFDA FDIWGQGTMVTVSSASTKGPSVFPLAPQVQLKQSG RGLVQPSQSLSITCTVSGFSLTNYGVHWVRQSPGK GLEWLGVIWSGGNTDYNTPFTSRLSINKDNSKSQV FFKMNSLQSNDTAIYYCARALTYYDYEFAYWGQGT LVTVSA |
| 392 | DVD401L | AB063 | AB033 | DIQMTQSPSSLSASVGDRVTITCQASQDITNYLNW YQQKPGKAPKLLIYDASNLETGVPSRFSGSGSGTD FTFTISSLQPEDIATYNCQQCENFPITFGQGTRLE IKRTVAAPDILLTQSPVILSVSPGERVSFSCRASQ SIGTNIHWYQQRTNGSPRLLIKYASESISGIPSRF SGSGSGTDFTLSINSVESEDIADYYCQQNNNWPTT FGAGTKLELKR |
| 393 | DVD402H | AB033 | AB063 | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPSVFPLAPEVQLVESG GGLVQPGGSLRLSCAASGFTFSIYSMNWVRQAPGK GLEWVSYISSSSSTIYYADSVKGRFTISRDNAKNS LYLQMNSLRDEDTAVYYCARDRGDFDAFDIWGQGT MVTVSS |
| 394 | DVD402L | AB033 | AB063 | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPDIQMTQSPSSLSASVGDRVTITCQASQ DITNYLNWYQQKPGKAPKLLIYDASNLETGVPSRF SGSGSGTDFTFTISSLQPEDIATYNCQQCENFPIT FGQGTRLEIKR |

Example 2.75

Generation of EGFR (Seq. 2) and ErbB3 (Seq. 2) DVD-Igs with Linker Set 4

TABLE 107

| DVD SEQ ID NO | DVD Variable Domain Name | Outer Variable Domain Name | Inner Variable Domain Name | Sequence 12345678901234567890123456789012345 |
|---|---|---|---|---|
| 395 | DVD405H | AB063 | AB033 | EVQLVESGGGLVQPGGSLRLSCAASGFTFSIYSMN WVRQAPGKGLEWVSYISSSSSTIYYADSVKGRFTI SRDNAKNSLYLQMNSLRDEDTAVYYCARDRGDFDA FDIWGQGTMVTVSSASTKGPQVQLKQSGPGLVQPS QSLSITCTVSGFSLTNYGVHWVRQSPGKGLEWLGV IWSGGNTDYNTPFTSRLSINKDNSKSQVFFKMNSL QSNDTAIYYCARALTYYDYEFAYWGQGTLVTVSA |
| 396 | DVD405L | AB063 | AB033 | DIQMTQSPSSLSASVGDRVTITCQASQDITNYLNW YQQKPGKAPKLLIYDASNLETGVPSRFSGSGSGTD FTFTISSLQPEDIATYNCQQCENFPITFGQGTRLE IKRTVAAPSVFIFPPDILLTQSPVILSVSRGERVS FSCRASQSIGTNIHWYQQRTNGSPRLLIKYASESI SGIPSRFSGSGSGTDFTLSINSVESEDIADYYCQQ NNNWPTTFGAGTKLELKR |
| 397 | DVD406H | AB033 | AB063 | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPEVQLVESGGGLVQPG GSLRLSCAASGFTFSIYSMNWVRQAPGKGLEWVSY ISSSSSTIYYADSVKGRFTISRDNAKNSLYLQMNS LRDEDTAVYYCARDRGDFDAFDIWGQGTMVTVSS |
| 398 | DVD406L | AB033 | AB063 | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPSVFIFPPDIQMTQSPSSLSASVGDRVT ITCQASQDITNYLNWYQQKPGKAPKLLIYDASNLE TGVPSRFSGSGSGTDFTFTISSLQPEDIATYNCQQ CENFPITFGQGTRLEIKR |

Example 2.76

Generation of EGFR (Seq. 1) and ErbB3 (Seq. 2) DVD-Igs

TABLE 108

| DVD SEQ ID NO | DVD Variable Domain Name | Outer Variable Domain Name | Inner Variable Domain Name | Sequence 12345678901234567890123456789012345 |
|---|---|---|---|---|
| 399 | DVD307H | AB063VH | AB003VH | EVQLVESGGGLVQPGGSLRLSCAASGFTFSIYSMN WVRQAPGKGLEWVSYISSSSSTIYYADSVKGRFTI SRDNAKNSLYLQMNSLRDEDTAVYYCARDRGDFDA FDIWGQGTMVTVSSASTKGPQVQLQESGPGLVKPS ETLSLTCTVSGGSVSSGDYYWTWIRQSPGKGLEWI GHIYYSGNTNYNPSLKSRLTISIDTSKTQFSLKLS SVTAADTAIYYCVRDRVTGAFDIWGQGTMVTVSS |
| 400 | DVD307L | AB063VL | AB003VL | DIQMTQSPSSLSASVGDRVTITCQASQDITNYLNW YQQKPGKAPKLLIYDASNLETGVPSRFSGSGSGTD FTFTISSLQPEDIATYNCQQCENFPITFGQGTRLE IKRTVAAPDIQMTQSPSSLSASVGDRVTITCQASQ DISNYLNWYQQKPGKAPKLLIYDASNLETGVPSRF SGSGSGTDFTFTISSLQPEDIATYFCQHFDHLPLA FGGGTKVEIKR |
| 401 | DVD308H | AB003VH | AB063VH | QVQLQESGPGLVKPSETLSLTCTVSGGSVSSGDYY WTWIRQSPGKGLEWIGHIYYSGNTNYNPSLKSRLT ISIDTSKTQFSLKLSSVTAADTAIYYCVRDRVTGA FDIWGQGTMVTVSSASTKGPEVQLVESGGGLVQPG |

TABLE 108-continued

| DVD SEQ ID NO | Outer Variable Domain Name | Inner Variable Domain Name | Variable Domain Name | Sequence 123456789012345678901234567890123456789012345 |
|---|---|---|---|---|
| | | | | GSLRLSCAASGFTFSIYSMNWVRQAPGKGLEWVSY ISSSSSTIYYADSVKGRFTISRDNAKNSLYLQMNS LRDEDTAVYYCARDRGDFDAFDIWGQGTMVTVSS |
| 402 | DVD308L | AB003VL | AB063VL | DIQMTQSPSSLSASVGDRVTITCQASQDISNYLNW YQQKPGKAPKLLIYDASNLETGVPSRFSGSGSGTD FTFTISSLQPEDIATYFCQHFDHLPLAFGGGTKVE IKRTVAAPDIQMTQSPSSLSASVGDRVTITCQASQ DITNYLNWYQQKPGKAPKLLIYDASNLETGVPSRF SGSGSGTDFTFTISSLQPEDIATYNCQQCENFPIT FGQGTRLEIKR |

Example 2.77

Generation of HGF (Seq. 1) and ErbB3 (Seq. 2) DVD-Igs

TABLE 109

| DVD SEQ ID NO | Outer Variable Domain Name | Inner Variable Domain Name | Sequence 123456789012345678901234567890123456789012345 |
|---|---|---|---|
| 403 | DVD309H | AB063VH | AB012VH | EVQLVESGGGLVQPGGSLRLSCAASGFTFSIYSMN WVRQAPGKGLEWVSYISSSSSTIYYADSVKGRFTI SRDNAKNSLYLQMNSLRDEDTAVYYCARDRGDFDA FDIWGQGTMVTVSSASTKGPQVQLVESGGGLVKPG GSLRLSCAASGFTFSDYYMSWIRQAPGKGLEWVSY ISSSGSTIYYADSVKGRFTISRDNAKNSLYLQMNS LRAEDTAVYYCARDEYNSGWYVLFDYWGQGTLVTV SS |
| 404 | DVD309L | AB063VL | AB012VL | DIQMTQSPSSLSASVGDRVTITCQASQDITNYLNW YQQKPGKAPKLLIYDASNLETGVPSRFSGSGSGTD FTFTISSLQPEDIATYNCQQCENFPITFGQGTRLE IKRTVAAPDIQMTQSPSSVSASVGDRVTITCRASQ GISSWLAWYQQKPGKAPNLLIYEASSLQSGVPSRF GGSGSGTDFTLTISSLQPEDFATYYCQQANGFPWT FGQGTKVEIKR |
| 405 | DVD310H | AB012VH | AB063VH | QVQLVESGGGLVKPGGSLRLSCAASGFTFSDYYMS WIRQAPGKGLEWVSYISSSGSTIYYADSVKGRFTI SRDNAKNSLYLQMNSLRAEDTAVYYCARDEYNSGW YVLFDYWGQGTLVTVSSASTKGPEVQLVESGGGLV QPGGSLRLSCAASGFTFSIYSMNWVRQAPGKGLEW VSYISSSSSTIYYADSVKGRFTISRDNAKNSLYLQ MNSLRDEDTAVYYCARDRGDFDAFDIWGQGTMVTV SS |
| 406 | DVD310L | AB012VL | AB063VL | DIQMTQSPSSVSASVGDRVTITCRASQGISSWLAW YQQKPGKAPNLLIYEASSLQSGVPSRFGGSGSGTD FTLTISSLQPEDFATYYCQQANGFPWTFGQGTKVE IKRTVAAPDIQMTQSPSSLSASVGDRVTITCQASQ DITNYLNWYQQKPGKAPKLLIYDASNLETGVPSRF SGSGSGTDFTFTISSLQPEDIATYNCQQCENFPIT FGQGTRLEIKR |

Example 2.78

Generation of VEGF (Seq. 1) and DLL4 (Seq. 2)
DVD-Igs with Linker Set 1

TABLE 110

| DVD SEQ ID NO | Variable Domain Name | Outer Variable Domain Name | Inner Variable Domain Name | Sequence 123456789012345678901234567890123456789012345 |
|---|---|---|---|---|
| 407 | DVD441H | AB069 | AB014 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPEVQLVESGGGLVQPG GSLRLSCAASGYTFTNYGMNWVRQAPGKGLEWVGW INTYTGEPTYAADFKRRFTFSLDISKSTAYLQMNS LRAEDTAVYYCAKYPHYYGSSHWYFDVWGQGTLVT VSS |
| 408 | DVD441L | AB069 | AB014 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPDIQMTQSPSSLSASVGDRVTITC SASQDISNYLNWYQQKPGKAPKVLIYFTSSLHSGV PSRFSGSGSGTDFTLTISSLQPEDFATYYCQQYST VPWTFGQGTKVEIKR |
| 409 | DVD442H | AB014 | AB069 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLVQSGAEV KKPGASVKISCKASGYSFTAYYIHWVKQAPGQGLE WIGYISSYNGATNYNQKFKGRVTFTTDTSTSTAYM ELRSLRSDDTAVYYCARDYDYDVGMDYWGQGTLVT VSS |
| 410 | DVD442L | AB014 | AB069 | DIQMTQSPSSLSASVGDRVTITCSASQDISNYLNW YQQKPGKAPKVLIYFTSSLHSGVPSRFSGSGSGTD FTLTISSLQPEDFAIYYCQQYSTVPWTFGQGTKVE IKRTVAAPDIVMTQSPDSLAVSLGERATISCRASE SVDNYGISFMKWFQQKPGQPPKLLIYAASNQGSGV PDRFSGSGSGTDFTLTISSLQAEDVAVYYCQQSKE VPWTFGGGTKVEIKR |

Example 2.79

Generation of VEGF (Seq. 1) and DLL4 (Seq. 2)
DVD-Igs with Linker Set 2

TABLE 111

| DVD SEQ ID NO | Variable Domain Name | Outer Variable Domain Name | Inner Variable Domain Name | Sequence 123456789012345678901234567890123456789012345 |
|---|---|---|---|---|
| 411 | DVD447H | AB069 | AB014 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPSVFPLAPEVQLVESG GGLVQPGGSLRLSCAASGYTFTNYGMNWVRQAPGK GLEWVGWINTYTGEPTYAADFKRRFTFSLDTSKST AYLQMNSLRAEDTAVYYCAKYPHYYGSSHWYFDVW GQGTLVTVSS |
| 412 | DVD447L | AB069 | AB014 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPSVFIFPPDIQMTQSPSSLSASVG DRVTITCSASQDISNYLNWYQQKPGKAPKVLIYFT SSLHSGVPSRFSGSGSGTDFTLTISSLQPEDFATY YCQQYSTVPWTFGQGTKVEIKR |

TABLE 111-continued

| DVD SEQ ID NO | DVD Variable Domain Name | Outer Variable Domain Name | Inner Variable Domain Name | Sequence 123456789012345678901234567890123456 |
|---|---|---|---|---|
| 413 | DVD448H | AB014 | AB069 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPQVQL VQSGAEVKKPGASVKISCKASGYSFTAYYIHWVKQ APGQGLEWIGYISSYNGATNYNQKFKGRVTFTTDT STSTAYMELRSLRSDDTAVYYCARDYDYDVGMDYW GQGTLVTVSS |
| 414 | DVD448L | AB014 | AB069 | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPDIVMTQSPDSLAVSLGERAT ISCRASESVDNYGISFMKWFQQKPGQPPKLLIYAA SNQGSGVPDRFSGSGSGTDFTLTISSLQAEDVAVY YCQQSKEVPWTFGGGTKVEIKR |

Example 2.80

Generation of VEGF (Seq. 1) and DLL4 (Seq. 2) DVD-Igs with Linker Set 3

TABLE 112

| DVD SEQ ID NO | DVD Variable Domain Name | Outer Variable Domain Name | Inner Variable Domain Name | Sequence 123456789012345678901234567890123456 |
|---|---|---|---|---|
| 415 | DVD453H | AB069 | AB014 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPSVFPLAPEVQLVESG GGLVQPGGSLRLSCAASGYTFTNYGMNWVRQAPGK GLEWVGWINTYTGEPTYAADFKRRFTFSLDTSKST AYLQMNSLRAEDTAVYYCAKYPHYYGSSHWYFDVW GQGTLVTVSS |
| 416 | DVD453L | AB069 | AB014 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPDIQMTQSPSSLSASVGDRVTITC SASQDISNYLNWYQQKPGKAPKVLIYFTSSLHSGV PSRFSGSGSGTDFTLTISSLQPEDFATYYCQQYST VPWTFGQGTKVEIKR |
| 417 | DVD454H | AB014 | AB069 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPQVQL VQSGAEVKKPGASVKISCKASGYSFTAYYIHWVKQ APGQGLEWIGYISSYNGATNYNQKFKGRVTFTTDT STSTAYMELRSLRSDDTAVYYCARDYDYDVGMDYW GQGTLVTVSS |
| 418 | DVD454L | AB014 | AB069 | DIQMTQSPSSLSASVGDRVTITCSASQDISNYLNW YQQKPGKAPKVLIYFTSSLHSGVPSRFSGSGSGTD FTLTISSLQPEDFATYYCQQYSTVRWTFGQGTKVE IKRTVAAPDIVMTQSRDSLAVSLGERATISCRASE SVDNYGISFMKWFQQKPGQPPKLLIYAASNQGSGV PDRFSGSGSGTDFTLTISSLQAEDVAVYYCQQSKE VPWTFGGGTKVEIKR |

Example 2.81

Generation of VEGF (Seq. 1) and DLL4 (Seq. 2)
DVD-Igs with Linker Set 4

TABLE 113

| DVD SEQ ID NO | Variable Domain Name | Outer Variable Domain Name | Inner Variable Domain Name | Sequence 123456789012345678901234567890123456 |
|---|---|---|---|---|
| 419 | DVD459H | AB069 | AB014 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPEVQLVESGGGLVQPG GSLRLSCAASGYTFTNYGMNWVRQAPGKGLEWVGW INTYTGEPTYAADFKRRFTFSLDTSKSTAYLQMNS LRAEDTAVYYCAKYPHYYGSSHWYFDVWGQGTLVT VSS |
| 420 | DVD459L | AB069 | AB014 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPSVFIFPPDIQMTQSPSSLSASVG DRVTITCSASQDISNYLNWYQQKPGKAPKVLIYFT SSLHSGVPSRFSGSGSGTDFTLTISSLQPEDFATY YCQQYSTVPWTFGQGTKVEIKR |
| 421 | DVD460H | AB014 | AB069 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLVQSGAEV KKPGASVKISCKASGYSFTAYYIHWVKQAPGQGLE WIGYISSYNGATNYNQKFKGRVTFTTDTSTSTAYM ELRSLRSDDTAVYYCARDYDYDVGMDYWGQGTLVT VSS |
| 422 | DVD460L | AB014 | AB069 | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPDIVMTQSPDSLAVSLGERAT ISCRASESVDNYGISFMKWFQQKPGQPPKLLIYAA SNQGSGVPDRFSGSGSGTDFTLTISSLQAEDVAVY YCQQSKEVPWTFGGGTKVEIKR |

Example 2.82

Generation of VEGF (Seq. 2) and DLL4 (Seq. 2)
DVD-Igs with Linker Set 1

TABLE 114

| DVD SEQ ID NO | Variable Domain Name | Outer Variable Domain Name | Inner Variable Domain Name | Sequence 123456789012345678901234567890123456 |
|---|---|---|---|---|
| 423 | DVD443H | AB069 | AB070 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPEVQLVESGGGLVQPG GSLRLSCAASGFTISDYWIHWVRQAPGKGLEWVAG ITPAGGYTYYADSVKGRFTISADTSKNTAYLQMNS LRAEDTAVYYCARFVFFLPYAMDYWGQGTLVTVSS |
| 424 | DVD443L | AB069 | AB070 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPDIQMTQSPSSLSASVGDRVTITC RASQDVSTAVAWYQQKPGKAPKLLIYSASFLYSGV PSRFSGSGSGTDFTLTISSLQPEDFATYYCQQSYT TPPTFGQGTKVEIKR |
| 425 | DVD444H | AB070 | AB069 | EVQLVESGGGLVQPGGSLRLSCAASGFTISDYWIH WVRQAPGKGLEWVAGITPAGGYTYYADSVKGRFTI |

TABLE 114-continued

| DVD SEQ ID NO | DVD Variable Domain Name | Outer Variable Domain Name | Inner Variable Domain Name | Sequence 123456789012345678901234567890123456789012345 |
|---|---|---|---|---|
| | | | | SADTSKNTAYLQMNSLRAEDTAVYYCARFVFFLPY AMDYWGQGTLVTVSSASTKGPQVQLVQSGAEVKKP GASVKISCKASGYSFTAYYIHWVKQAPGQGLEWIG YISSYNGATNYNQKFKGRVTFTTDTSTSTAYMELR SLRSDDTAVYYCARDYDYDVGMDYWGQGTLVTVSS |
| 426 | DVD444L | AB070 | AB069 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPDIVMTQSPDSLAVSLGERATISCRASE SVDNYGISFMKWFQQKPGQPPKLLIYAASNQGSGV PDRFSGSGSGTDFTLTISSLQAEDVAVYYCQQSKE VPWTFGGGTKVEIKR |

Example 2.83

Generation of VEGF (Seq. 2) and DLL4 (Seq. 2) DVD-Igs with Linker Set 2

TABLE 115

| DVD SEQ ID NO | DVD Variable Domain Name | Outer Variable Domain Name | Inner Variable Domain Name | Sequence 123456789012345678901234567890123456789012345 |
|---|---|---|---|---|
| 427 | DVD449H | AB069 | AB070 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPSVFPLAPEVQLVESG GGLVQPGGSLRLSCAASGFTISDYWIHWVRQAPGK GLEWVAGITPAGGYTYYADSVKGRFTISADTSKNT AYLQMNSLRAEDTAVYYCARFVFFLPYAMDYWGQG TLVTVSS |
| 428 | DVD449L | AB069 | AB070 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPSVFIFPPDIQMTQSPSSLSASVG DRVTITCRASQDVSTAVAWYQQKPGKAPKLLIYSA SFLYSGVPSRFSGSGSGTDFTLIISSLQPEDFATY YCQQSYTTPPTFGQGTKVEIKR |
| 429 | DVD450H | AB070 | AB069 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPQVQLVQS GAEVKKPGASVKISCKASGYSFTAYYIHWVKQAPG QGLEWIGYISSYNGATNYNQKFKGRVTFTTDTSTS TAYMELRSLRSDDTAVYYCARDYDYDVGMDYWGQG TLVTVSS |
| 430 | DVD450L | AB070 | AB069 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPSVFTFPPDIVMTQSPDSLAVSLGERAT ISCRASESVDNYGISFMKWFQQKPGQPPKLLIYAA SNQGSGVPDRFSGSGSGTDFTLTISSLQAEDVAVY YCQQSKEVPWIFGGGTKVEIKR |

Example 2.84

Generation of VEGF (Seq. 2) and DLL4 (Seq. 2)
DVD-Igs with Linker Set 3

TABLE 116

| DVD SEQ ID NO | DVD Variable Domain Name | Outer Variable Domain Name | Inner Variable Domain Name | Sequence 12345678901234567890123456789012345 |
|---|---|---|---|---|
| 431 | DVD455H | AB069 | AB070 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPSVFPLAPEVQLVESG GGLVQPGGSLRLSCAASGFTISDYWIHWVRQAPGK GLEWVAGITPAGGYTYYADSVKGRFTISADTSKNT AYLQMNSLRAEDTAVYYCARFVFFLPYAMDYWGQG TLVTVSS |
| 432 | DVD455L | AB069 | AB070 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPDIQMTQSPSSLSASVGDRVTITC RASQDVSTAVAWYQQKPGKAPKLLIYSASFLYSGV PSRFSGSGSGTDFTLTISSLQPEDFATYYCQQSYT TPPTFGQGTKVEIKR |
| 433 | DVD456H | AB070 | AB069 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPQVQLVQS GAEVKKPGASVKISCKASGYSFTAYYIHWVKQAPG QGLEWIGYISSYNGATNYNQKFKGRVTFTTDTSTS TAYMELRSLRSDDTAVYYCARDYDYDVGMDYWGQG TLVTVSS |
| 434 | DVD456L | AB070 | AB069 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPDIVMTQSPDSLAVSLGERATISCRASE SVDNYGISFMKWFQQKPGQPPKLLIYAASNQGSGV PDRFSGSGSGTDFTLTISSLQAEDVAVYYCQQSKE VPWTFGGGTKVEIKR |

Example 2.85

Generation of VEGF (Seq. 2) and DLL4 (Seq. 2)
DVD-Igs with Linker Set 4

TABLE 117

| DVD SEQ ID NO | DVD Variable Domain Name | Outer Variable Domain Name | Inner Variable Domain Name | Sequence 12345678901234567890123456789012345 |
|---|---|---|---|---|
| 435 | DVD461H | AB069 | AB070 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPEVQLVESGGGLVQPG GSLRLSCAASGFTISDYWIHWVRQAPGKGLEWVAG ITPAGGYTYYADSVKGRFTISADTSKNTAYLQMNS LRAEDTAVYYCARFVFFLPYAMDYWGQGTLVTVSS |
| 436 | DVD461L | AB069 | AB070 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPSVFIFPPDIQMTQSPSSLSASVG DRVTITCRASQDVSTAVAWYQQKPGKAPKLLIYSA SFLYSGVPSRFSGSGSGTDFTLTISSLQPEDFATY YCQQSYTTPPTFGQGTKVEIKR |
| 437 | DVD462H | AB070 | AB069 | EVQLVESGGGLVQPGGSLRLSCAASGFTISDYWIH WVRQAPGKGLEWVAGITPAGGYTYYADSVKGRFTI |

TABLE 117-continued

| DVD SEQ ID NO | DVD Variable Domain Name | Outer Variable Domain Name | Inner Variable Domain Name | Sequence 123456789012345678901234567890112345 |
|---|---|---|---|---|
| | | | | SADTSKNTAYLQMNSLRAEDTAVYYCARFVFFLPY AMDYWGQGTLVTVSSASTKGPQVQLVQSGAEVKKP GASVKISCKASGYSFTAYYIHWVKQAPGQGLEWIG YISSYNGATNYNQKFKGRVTFTTDTSTSTAYMELR SLRSDDTAVYYCARDYDYDVGMDYWGQGTLVTVSS |
| 438 | DVD462L | AB070 | AB069 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPSVFIFPPDIVMTQSRDSLAVSLGERAT ISCRASESVDNYGISFMKWFQQKRGQPPKLLIYAA SNQGSGVPDRFSGSGSGTDFTLTISSLQAEDVAVY YCQQSKEVPWTFGGGTKVEIKR |

Example 2.86

Generation of VEGF (Seq. 3) and DLL4 (Seq. 2) DVD-Igs with Linker Set 1

TABLE 118

| DVD SEQ ID NO | DVD Variable Domain Name | Outer Variable Domain Name | Inner Variable Domain Name | Sequence 123456789012345678901234567890112345 |
|---|---|---|---|---|
| 439 | DVD445H | AB069 | AB071 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPEVQLVESGGGLVQPG GSLRLSCAASGFTINASWIHWVRQAPGKGLEWVGA IYPYSGYTNYADSVKGRFTISADTSKNTAYLQMNS LRAEDTAVYYCARWGHSTSPWAMDYWGQGTLVTVS S |
| 440 | DVD445L | AB069 | AB071 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPDIQMTQSPSSLSASVGDRVTITC RASQVIRRSLAWYQQKPGKAPKLLIYAASNLASGV PSRFSGSGSGTDFTLTISSLQPEDFAIYYCQQSNT SPLIFGQGTKVEIKR |
| 441 | DVD446H | AB071 | AB069 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPQVQLVQSGAEVKK PGASVKISCKASGYSFTAYYIHWVKQAPGQGLEWI GYISSYNGATNYNQKFKGRVTFTTDTSTSTAYMEL RSLRSDDTAVYYCARDYDYDVGMDYWGQGTLVTVS S |
| 442 | DVD446L | AB071 | AB069 | DIQMTQSPSSLSASVGDRVTITCRASQVIRRSLAW YQQKPGKAPKLLIYAASNLASGVPSRFSGSGSGTD FTLTISSLQPEDFATYYCQQSNTSRLTFGQGTKVE IKRTVAAPDIVMTQSPDSLAVSLGERATISCRASE SVDNYGISFMKWFQQKPGQPPKLLIYAASNQGSGV PDRFSGSGSGTDFTLTISSLQAEDVAVYYCQQSKE VPWTFGGGTKVEIKR |

Example 2.87

Generation of VEGF (Seq. 3) and DLL4 (Seq. 2) DVD-Igs with Linker Set 2

TABLE 119

| DVD SEQ ID NO | DVD Variable Domain Name | Outer Variable Domain Name | Inner Variable Domain Name | Sequence 123456789012345678901234567890123456789012345 |
|---|---|---|---|---|
| 443 | DVD451H | AB069 | AB071 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPSVFPLAPEVQLVESG GGLVQPGGSLRLSCAASGFTINASWIHWVRQAPGK GLEWVGAIYPYSGYTNYADSVKGRFTISADTSKNT AYLQMNSLRAEDTAVYYCARWGHSTSPWAMDYWGQ GTLVTVSS |
| 444 | DVD451L | AB069 | AB071 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPSVFIFPPDIQMTQSPSSLSASVG DRVTITCRASQVIRRSLAWYQQKPGKAPKLLIYAA SNLASGVPSRFSGSGSGTDFTLTISSLQPEDFATY YCQQSNTSPLTFGQGTKVEIKR |
| 445 | DVD452H | AB071 | AB069 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPSVFPLAPQVQLVQ SGAEVKKPGASVKISCKASGYSFTAYYIHWVKQAP GQGLEWIGYISSYNGATNYNQKFKGRVTFTTDTST STAYMELRSLRSDDTAVYYCARDYDYDVGMDYWGQ GTLVTVSS |
| 446 | DVD452L | AB071 | AB069 | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPSVFIFPPDIVMTQSPDSLAVSLGERAT ISCRASESVDNYGISFMKWFQQKPGQPPKLLIYAA SNQGSGVPDRFSGSGSGTDFTLTISSLQAEDVAVY YCQQSKEVPWTFGGGTKVEIKR |

Example 2.88

Generation of VEGF (Seq. 3) and DLL4 (Seq. 2) DVD-Igs with Linker Set 3

TABLE 120

| DVD SEQ ID NO | DVD Variable Domain Name | Outer Variable Domain Name | Inner Variable Domain Name | Sequence 123456789012345678901234567890123456789012345 |
|---|---|---|---|---|
| 447 | DVD457H | AB069 | AB071 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPSVFPLAPEVQLVESG GGLVQPGGSLRLSCAASGFTINASWIHWVRQAPGK GLEWVGAIYPYSGYTNYADSVKGRFTISADTSKNT AYLQMNSLRAEDTAVYYCARWGHSTSPWAMDYWGQ GTLVTVSS |
| 448 | DVD457L | AB069 | AB071 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPDIQMTQSPSSLSASVGDRVTITC RASQVIRRSLAWYQQKPGKAPKLLIYAASNLASGV PSRFSGSGSGTDFTLTISSLQPEDFATYYCQQSNT SPLTFGQGTKVEIKR |

TABLE 120-continued

| DVD SEQ ID NO | DVD Variable Domain Name | Outer Variable Domain Name | Inner Variable Domain Name | Sequence 12345678901234567890123456789012345 |
|---|---|---|---|---|
| 449 | DVD458H | AB071 | AB069 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPSVFPLAPQVQLVQ SGAEVKKPGASVKISCKASGYSFTAYYIHWVKQAP GQGLEWIGYISSYNGATNYNQKFKGRVTFTTDTST STAYMELRSLRSDDTAVYYCARDYDYDVGMDYWGQ GTLVTVSS |
| 450 | DVD458L | AB071 | AB069 | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPDIVMTQSPDSLAVSLGERATISCRASE SVDNYGISFMKWFQQKPGQPPKLLIYAASNQGSGV PDRFSGSGSGTDFTLTISSLQAEDVAVYYCQQSKE VPWTFGGGTKVEIKR |

Example 2.89

Generation of VEGF (Seq. 3) and DLL4 (Seq. 2) DVD-Igs with Linker Set 4

TABLE 121

| DVD SEQ ID NO | DVD Variable Domain Name | Outer Variable Domain Name | Inner Variable Domain Name | Sequence 12345678901234567890123456789012345 |
|---|---|---|---|---|
| 451 | DVD463H | AB069 | AB071 | QVQLVQSGAEVKKPGASVKISCKASGYSFTAYYIH WVKQAPGQGLEWIGYISSYNGATNYNQKFKGRVTF TTDTSTSTAYMELRSLRSDDTAVYYCARDYDYDVG MDYWGQGTLVTVSSASTKGPEVQLVESGGGLVQPG GSLRLSCAASGFTINASWIHWVRQAPGKGLEWVGA IYPYSGYTNYADSVKGRFTISADTSKNTAYLQMNS LRAEDTAVYYCARWGHSTSPWAMDYWGQGTLVTVS S |
| 452 | DVD463L | AB069 | AB071 | DIVMTQSPDSLAVSLGERATISCRASESVDNYGIS FMKWFQQKPGQPPKLLIYAASNQGSGVPDRFSGSG SGTDFTLTISSLQAEDVAVYYCQQSKEVPWTFGGG TKVEIKRTVAAPSVFIFPPDIQMTQSPSSLSASVG DRVTITCRASQVIRRSLAWYQQKPGKAPKLLIYAA SNLASGVPSRFSGSGSGTDFTLTISSLQPEDFATY YCQQSNTSPLTFGQGTKVEIKR |
| 453 | DVD464H | AB071 | AB069 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPQVQLVQSGAEVKK PGASVKISCKASGYSFTAYYIHWVKQAPGQGLEWI GYISSYNGATNYNQKFKGRVTFTTDTSTSTAYMEL RSLRSDDTAVYYCARDYDYDVGMDYWGQGTLVTVS S |
| 454 | DVD464L | AB071 | AB069 | DIQMTQSPSSLSASVGDRVTITCRASQVIRRSLAW YQQKPGKAPKLLIYAASNLASGVPSRFSGSGSGTD FTLTISSLQPEDFATYYCQQSNTSRLTFGQGTKVE IKRTVAAPSVFIFPPDIVMTQSPDSLAVSLGERAT ISCRASESVDNYGISFMKWFQQKPGQPPKLLIYAA SNQGSGVPDRFSGSGSGTDFTLTISSLQAEDVAVY YCQQSKEVPWTFGGGTKVEIKR |

Example 2.90

Generation of VEGF (Seq. 2) and DLL4 (Seq. 1)
DVD-Igs with Linker Set 1

TABLE 122

| DVD SEQ ID NO | Variable Domain Name | Outer Variable Domain Name | Inner Variable Domain Name | Sequence 123456789012345678901234567890123456789012345 |
|---|---|---|---|---|
| 455 | DVD465H | AB015 | AB070 | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPEVQLVESGGGLVQPGG SLRLSCAASGFTISDYWIHWVRQAPGKGLEWVAGI TPAGGYTYYADSVKGRFTISADTSKNTAYLQMNSL RAEDTAVYYCARFVFFLPYAMDYWGQGTLVTVSS |
| 456 | DVD465L | AB015 | AB070 | DIQMTQSPSSLSASVGDRVTITCRASQDVSTAVAW YQQKPGKAPKLLIYSASFLYSGVPSRFSGSGSGTD FTLTISSLQPEDFATTYYCQQSYTGTVTFGQGTKV EIKRTVAAPDIQMTQSPSSLSASVGDRVTITCRAS QDVSTAVAWYQQKPGKAPKLLIYSASFLYSGVPSR FSGSGSGTDFTLTISSLQPEDFATTYYCQQSYTTPP TFGQGTKVEIKR |
| 457 | DVD466H | AB070 | AB015 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPEVQLVESGGGLVQP GGSLRLSCAASGFTFTDNWISWVRQAPGKGLEWVG YISPNSGFTYYADSVKGRFTISADTSKNTAYLQMN SLRAEDTAVYYCARDNFGGYFDYWGQGTLVTVSS |
| 458 | DVD466L | AB070 | AB015 | DIQMTQSPSSLSASVGDRVTITCRASQDVSTAVAW YQQKPGKAPKLLIYSASFLYSGVPSRFSGSGSGTD FTLTISSLQPEDFATTYYCQQSYTTPPTFGQGTKVE IKRTVAAPDIQMTQSPSSLSASVGDRVTITCRASQ DVSTAVAWYQQKPGKAPKLLIYSASFLYSGVPSRF SGSGSGTDFTLTISSLQPEDFATTYYCQQSYTGTV TFGQGTKVEIKR |

Example 2.91

Generation of VEGF (Seq. 2) and DLL4 (Seq. 1)
DVD-Igs with Linker Set 2

TABLE 123

| DVD SEQ ID NO | Variable Domain Name | Outer Variable Domain Name | Inner Variable Domain Name | Sequence 123456789012345678901234567890123456789012345 |
|---|---|---|---|---|
| 459 | DVD471H | AB015 | AB070 | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPSVFPLAPEVQLVESGG GLVQPGGSLRLSCAASGFTISDYWIHWVRQAPGKG LEWVAGITPAGGYTYYADSVKGRFTISADTSKNTA YLQMNSLRAEDTAVYYCARFVFFLPYAMDYWGQGT LVTVSS |
| 460 | DVD471L | AB015 | AB070 | DIQMTQSPSSLSASVGDRVTITCRASQDVSTAVAW YQQKPGKAPKLLIYSASFLYSGVPSRFSGSGSGTD FTLTISSLQPEDFATTYYCQQSYTGTVTFGQGTKV EIKRTVAAPSVFIFPPDIQMTQSPSSLSASVGDRV TITCRASQDVSTAVAWYQQKPGKAPKLLIYSASFL YSGVPSRFSGSGSGTDFTLTISSLQPEDFATTYYCQ QSYTTPPTFGQGTKVEIKR |
| 461 | DVD472H | AB070 | AB015 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY |

TABLE 123-continued

| DVD SEQ ID NO | DVD Variable Domain Name | Outer Variable Domain Name | Inner Variable Domain Name | Sequence 12345678901234567890123456789012345 |
|---|---|---|---|---|
| | | | | AMDYWGQGTLVTVSSASTKGPSVFPLAPEVQLVES GGGLVQPGGSLRLSCAASGFTFTDNWISWVRQAPG KGLEWVGYISPNSGFTYYADSVKGRFTISADTSKN TAYLQMNSLRAEDTAVYYCARDNFGGYFDYWGQGT LVTVSS |
| 462 | DVD472L | AB070 | AB015 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPSVFIFPPDIQMTQSPSSLSASVGDRVT ITCRASQDVSTAVAWYQQKPGKAPKLLIYSASFLY SGVPSRFSGSGSGTDFTLTISSLQPEDFATTYYCQ QSYTGTVTFGQGTKVEIKR |

Example 2.92

Generation of VEGF (Seq. 2) and DLL4 (Seq. 1)
DVD-Igs with Linker Set 3

TABLE 125

| DVD SEQ ID NO | DVD Variable Domain Name | Outer Variable Domain Name | Inner Variable Domain Name | Sequence 12345678901234567890123456789012345 |
|---|---|---|---|---|
| 463 | DVD477H | AB015 | AB070 | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPSVFPLAPEVQLVESGG GLVQPGGSLRLSCAASGFTISDYWIHWVRQAPGKG LEWVAGITPAGGYTYYADSVKGRFTISADTSKNTA YLQMNSLRAEDTAVYYCARFVFFLRYAMDYWGQGT LVTVSS |
| 464 | DVD477L | AB015 | AB070 | DIQMTQSPSSLSASVGDRVTITCRASQDVSTAVAW YQQKPGKAPKLLIYSASFLYSGVPSRFSGSGSGTD FTLTISSLQPEDFATTYYCQQSYTGTVTFGQGTKV EIKRTVAAPDIQMTQSPSSLSASVGDRVTITCRAS QDVSTAVAWYQQKPGKAPKLLIYSASFLYSGVPSR FSGSGSGTDFTLTISSLQPEDFATYYCQQSYTTPP TFGQGTKVEIKR |
| 465 | DVD478H | AB070 | AB015 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSSTKGPSVFPLAPEVQLVES GGGLVQPGGSLRLSCAASGFTFTDNWISWVRQAPG KGLEWVGYISPNSGFTYYADSVKGRFTISADTSKN TAYLQMNSLRAEDTAVYYCARDNFGGYFDYWGQGT LVTVSS |
| 466 | DVD478L | AB070 | AB015 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPDIQMTQSRSSLSASVGDRVTITCRASQ DVSTAVAWYQQKPGKAPKLLIYSASFLYSGVPSRF SGSGSGTDFTLTISSLQPEDFATTYYCQQSYTGTV TFGQGTKVEIKR |

Example 2.93

Generation of VEGF (Seq. 2) and DLL4 (Seq. 1)
DVD-Igs with Linker Set 4

TABLE 126

| DVD SEQ ID NO | DVD Variable Domain Name | Outer Variable Domain Name | Inner Variable Domain Name | Sequence 12345678901234567890123456789012345 |
|---|---|---|---|---|
| 467 | DVD483H | AB015 | AB070 | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPEVQLVESGGGLVQPGG SLRLSCAASGFTISDYWIHWVRQAPGKGLEWVAGI TPAGGYTYYADSVKGRFTISADTSKNTAYLQMNSL RAEDTAVYYCARFVFFLPYAMDYWGQGTLVTVSS |
| 468 | DVD483L | AB015 | AB070 | DIQMTQSPSSLSASVGDRVTITCRASQDVSTAVAW YQQKPGKAPKLLIYSASFLYSGVPSRFSGSGSGTD FTLTISSLQPEDFATTYYCQQSYTGTVTFGQGTKV EIKRTVAAPSVFIFPPDIQMTQSPSSLSASVGDRV TITCRASQDVSTAVAWYQQKPGKAPKLLIYSASFL YSGVPSRFSGSGSGTDFTLTISSLQPEDFATYYCQ QSYTTPPTFGQGTKVEIKR |
| 469 | DVD484H | AB070 | AB015 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPEVQLVESGGGLVQP GGSLRLSCAASGFTFTDNWISWVRQAPGKGLEWVG YISPNSGFTYYADSVKGRFTISADTSKNTAYLQMN SLRAEDTAVYYCARDNFGGYFDYWGQGTLVTVSS |
| 470 | DVD484L | AB070 | AB015 | DIQMTQSPSSLSASVGDRVTITCRASQDVSTAVAW YQQKPGKAPKLLIYSASFLYSGVPSRFSGSGSGTD FTLTISSLQPEDFATTYYCQQSYTTPPTFGQGTKVE IKRTVAAPSVFIFPPDIQMTQSPSSLSASVGDRVT ITCRASQDVSTAVAWYQQKPGKAPKLLIYSASFLY SGVPSRFSGSGSGTDFTLTISSLQPEDFATTYYCQ QSYTGTVTFGQGTKVEIKR |

Example 2.94

Generation of VEGF (Seq. 3) and DLL4 (Seq. 1)
DVD-Igs with Linker Set 1

TABLE 127

| DVD SEQ ID NO | DVD Variable Domain Name | Outer Variable Domain Name | Inner Variable Domain Name | Sequence 12345678901234567890123456789012345 |
|---|---|---|---|---|
| 471 | DVD467H | AB015 | AB071 | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPEVQLVESGGGLVQPGG SLRLSCAASGFTINASWIHWVRQAPGKGLEWVGAI YPYSGYTNYADSVKGRFTISADTSKNTAYLQMNSL RAEDTAVYYCARWGHSTSPWAMDYWGQGTLVTVSS |
| 472 | DVD467L | AB015 | AB071 | DIQMTQSPSSLSASVGDRVTITCRASQDVSTAVAW YQQKPGKARKLLIYSASFLYSGVPSRFSGSGSGTD FTLTISSLQPEDFATTYYCQQSYTGTVTFGQGTKV EIKRTVAAPDIQMTQSRSSLSASVGDRVTITCRAS QVIRRSLAWYQQKPGKAPKLLIYAASNLASGVPSR FSGSGSGTDFTLTISSLQPEDFATYYCQQSNTSPL TFGQGTKVEIKR |
| 473 | DVD468H | AB071 | AB015 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPEVQLVESGGGLVQ |

TABLE 127-continued

| DVD SEQ ID NO | DVD Variable Domain Name | Outer Variable Domain Name | Inner Variable Domain Name | Sequence 123456789012345678901234567890 12345 |
|---|---|---|---|---|
| | | | | PGGSLRLSCAASGFTFTDNWISWVRQAPGKGLEWV GYISPNSGFTYYADSVKGRFTISADTSKNTAYLQM NSLRAEDTAVYYCARDNFGGYFDYWGQGTLVTVSS |
| 474 | DVD468L | AB071 | AB015 | DIQMTQSPSSLSASVGDRVTITCRASQVIRRSLAW YQQKPGKAPKLLIYAASNLASGVPSRFSGSGSGTD FTLTISSLQPEDFATYYCQQSNTSRLTFGQGTKVE IKRTVAAPDIQMTQSPSSLSASVGDRVTITCRASQ DVSTAVAWYQQKPGKAPKLLIYSASFLYSGVPSRF SGSGSGTDFTLTISSLQPEDFATTYYCQQSYTGTV TFGQGTKVEIKR |

Example 2.95

Generation of VEGF (Seq. 3) and DLL4 (Seq. 1) DVD-Igs with Linker Set 2

TABLE 128

| DVD SEQ ID NO | DVD Variable Domain Name | Outer Variable Domain Name | Inner Variable Domain Name | Sequence 123456789012345678901234567890 12345 |
|---|---|---|---|---|
| 475 | DVD473H | AB015 | AB071 | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPSVFPLAPEVQLVESGG GLVQPGGSLRLSCAASGFTINASWIHWVRQAPGKG LEWVGAIYPYSGYTNYADSVKGRFTISADTSKNTA YLQMNSLRAEDTAVYYCARWGHSTSPWAMDYWGQG TLVTVSS |
| 476 | DVD473L | AB015 | AB071 | DIQMTQSPSSLSASVGDRVTITCRASQDVSTAVAW YQQKPGKAPKLLIYSASFLYSGVPSRFSGSGSGTD FTLTISSLQPEDFATTYYCQQSYTGTVTFGQGTKV EIKRTVAAPSVFIFPPDIQMTQSPSSLSASVGDRV TITCRASQVIRRSLAWYQQKPGKAPKLLIYAASNL ASGVPSRFSGSGSGTDFTLTISSLQPEDFATYYCQ QSNTSPLTFGQGTKVEIKR |
| 477 | DVD474H | AB071 | AB015 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPSVFPLAPEVQLVE SGGGLVQPGGSLRLSCAASGFTFTDNWISWVRQAP GKGLEWVGYISPNSGFTYYADSVKGRFTISADTSK NTAYLQMNSLRAEDTAVYYCARDNFGGYFDYWGQG TLVTVSS |
| 478 | DVD474L | AB071 | AB015 | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPSVFIFPPDIQMTQSPSSLSASVGDRVT ITCRASQDVSTAVAWYQQKPGKAPKLLIYSASFLY SGVPSRFSGSGSGTDFTLTISSLQPEDFATTYYCQ QSYTGTVTFGQGTKVEIKR |

Example 2.96

Generation of VEGF (Seq. 3) and DLL4 (Seq. 1)
DVD-Igs with Linker Set 3

TABLE 129

| DVD SEQ ID NO | DVD Variable Domain Name | Outer Variable Domain Name | Inner Variable Domain Name | Sequence 12345678901234567890123456789012345 |
|---|---|---|---|---|
| 479 | DVD479H | AB015 | AB071 | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPSVFPLAPEVQLVESGG GLVQPGGSLRLSCAASGFTINASWIHWVRQAPGKG LEWVGAIYPYSGYTNYADSVKGRFTISADTSKNTA YLQMNSLRAEDTAVYYCARWGHSTSRWAMDYWGQG TLVTVSS |
| 480 | DVD479L | AB015 | AB071 | DIQMTQSPSSLSASVGDRVTITCRASQDVSTAVAW YQQKPGKAPKLLIYSASFLYSGVPSRFSGSGSGTD FTLTISSLQPEDFATTYYCQQSYTGTVTFGQGTKV EIKRTVAAPDIQMTQSPSSLSASVGDRVTITCRAS QVIRRSLAWYQQKPGKAPKLLIYAASNLASGVPSR FSGSGSGTDFTLTISSLQPEDFATYYCQQSNTSPL TFGQGTKVEIKR |
| 481 | DVD480H | AB071 | AB015 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPSVFPLAPEVQLVE SGGGLVQPGGSLRLSCAASGFTFTDNWISWVRQAP GKGLEWVGYISPNSGFTYYADSVKGRFTISADTSK NTAYLQMNSLRAEDTAVYYCARDNFGGYFDYWGQG TLVTVSS |
| 482 | DVD480L | AB071 | AB015 | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPDIQMTQSPSSLSASVGDRVTITCRASQ DVSTAVAWYQQKPGKAPKLLIYSASFLYSGVPSRF SGSGSGTDFTLTISSLQPEDFATTYYCQQSYTGTV TFGQGTKVEIKR |

Example 2.97

Generation of VEGF (Seq. 3) and DLL4 (Seq. 1)
DVD-Igs with Linker Set 4

TABLE 130

| DVD SEQ ID NO | DVD Variable Domain Name | Outer Variable Domain Name | Inner Variable Domain Name | Sequence 12345678901234567890123456789012345 |
|---|---|---|---|---|
| 483 | DVD485H | AB015 | AB071 | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPEVQLVESGGGLVQPGG SLRLSCAASGFTINASWIHWVRQAPGKGLEWVGAI YPYSGYTNYADSVKGRFTISADTSKNTAYLQMNSL RAEDTAVYYCARWGHSTSPWAMDYWGQGTLVTVSS |
| 484 | DVD485L | AB015 | AB071 | DIQMTQSPSSLSASVGDRVTITCRASQDVSTAVAW YQQKPGKAPKLLIYSASFLYSGVPSRFSGSGSGTD FTLTISSLQPEDFATTYYCQQSYTGTVTFGQGTKV EIKRTVAAPSVFIFPPDIQMTQSPSSLSASVGDRV TITCRASQVIRRSLAWYQQKPGKAPKLLIYAASNL ASGVPSRFSGSGSGTDFTLTISSLQPEDFATYYCQ QSNTSPLTFGQGTKVEIKR |
| 485 | DVD486H | AB071 | AB015 | EVQLVESGGGLVQPGGSLRLSCAASGFTINASWIH WVRQAPGKGLEWVGAIYPYSGYTNYADSVKGRFTI |

TABLE 130-continued

| DVD SEQ ID NO | DVD Variable Domain Name | Outer Variable Domain Name | Inner Variable Domain Name | Sequence 123456789012345678901234567890123456 |
|---|---|---|---|---|
| | | | | SADTSKNTAYLQMNSLRAEDTAVYYCARWGHSTSPWAMDYWGQGTLVTVSSASTKGPEVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSS |
| 486 | DVD486L | AB071 | AB015 | DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKR |

Example 2.98

Generation of VEGF (Seq. 1) and DLL4 (Seq. 1) DVD-Igs with Linker Set 1

TABLE 131

| DVD SEQ ID NO | DVD Variable Domain Name | Outer Variable Domain Name | Inner Variable Domain Name | Sequence 123456789012345678901234567890123456 |
|---|---|---|---|---|
| 487 | DVD469H | AB015 | AB014 | EVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSSASTKGPSVFPLAPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS |
| 488 | DVD469L | AB015 | AB014 | DIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKRTVAAPSVFIFPPDIQMTQSRSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR |
| 489 | DVD470H | AB014 | AB015 | EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPEVQLVESGGGLVQPGGSLRLSCAASGFTFTDNWISWVRQARGKGLEWVGYISPNSGFTYYADSVKGRFTISADTSKNTAYLQMNSLRAEDTAVYYCARDNFGGYFDYWGQGTLVTVSS |
| 490 | DVD470L | AB014 | AB015 | DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKR |

Example 2.99

Generation of VEGF (Seq. 1) and DLL4 (Seq. 1)
DVD-Igs with Linker Set 2

TABLE 132

| DVD SEQ ID NO | Variable Domain Name | Outer Variable Domain Name | Inner Variable Domain Name | Sequence 12345678901234567890123456789012345 |
|---|---|---|---|---|
| 491 | DVD475H | AB015 | AB014 | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPSVFPLAPEVQLVESGG GLVQPGGSLRLSCAASGYTFTNYGMNWVRQAPGKG LEWVGWINTYTGEPTYAADFKRRFTFSLDTSKSTA YLQMNSLRAEDTAVYYCAKYPHYYGSSHWYFDVWG QGTLVTVSS |
| 492 | DVD475L | AB015 | AB014 | DIQMTQSPSSLSASVGDRVTITCRASQDVSTAVAW YQQKPGKAPKLLIYSASFLYSGVPSRFSGSGSGTD FTLTISSLQPEDFATTYYCQQSYTGTVTFGQGTKV EIKRTVAAPDIQMTQSPSSLSASVGDRVTITCSAS QDISNYLNWYQQKPGKAPKVLIYFTSSLHSGVPSR FSGSGSGTDFTLTISSLQPEDFATYYCQQYSTVPW TFGQGTKVEIKR |
| 493 | DVD476H | AB014 | AB015 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPEVQL VESGGGLVQPGGSLRLSCAASGFTFTDNWISWVRQ APGKGLEWVGYISPNSGFTYYADSVKGRFTISADT SKNTAYLQMNSLRAEDTAVYYCARDNFGGYFDYWG QGTLVTVSS |
| 494 | DVD476L | AB014 | AB015 | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSPSSLSASVGDRVTITCRASQ DVSTAVAWYQQKPGKAPKLLIYSASFLYSGVPSRF SGSGSGTDFTLTISSLQPEDFATTYYCQQSYTGTV TFGQGTKVEIKR |

Example 2.100

Generation of VEGF (Seq. 1) and DLL4 (Seq. 1)
DVD-Igs with Linker Set 3

TABLE 133

| DVD SEQ ID NO | Variable Domain Name | Outer Variable Domain Name | Inner Variable Domain Name | Sequence 12345678901234567890123456789012345 |
|---|---|---|---|---|
| 495 | DVD481H | AB015 | AB014 | EVQLVESGGGLVQPGGSLRLSCAASGFTFTDNWIS WVRQAPGKGLEWVGYISPNSGFTYYADSVKGRFTI SADTSKNTAYLQMNSLRAEDTAVYYCARDNFGGYF DYWGQGTLVTVSSASTKGPEVQLVESGGGLVQPGG SLRLSCAASGYTFTNYGMNWVRQAPGKGLEWVGWI NTYTGEPTYAADFKRRFTFSLDTSKSTAYLQMNSL RAEDTAVYYCAKYPHYYGSSHWYFDVWGQGTLVTV SS |
| 496 | DVD481L | AB015 | AB014 | DIQMTQSPSSLSASVGDRVTITCRASQDVSTAVAW YQQKPGKAPKLLIYSASFLYSGVPSRFSGSGSGTD FTLTISSLQPEDFATTYYCQQSYTGTVTFGQGTKV EIKRTVAAPSVFIFPPDIQMTQSPSSLSASVGDRV TITCSASQDISNYLNWYQQKPGKAPKVLIYFTSSL HSGVPSRFSGSGSGTDFTLTISSLQPEDFATYYCQ QYSTVPWTFGQGTKVEIKR |

TABLE 133-continued

| DVD SEQ ID NO | DVD Variable Domain Name | Outer Variable Domain Name | Inner Variable Domain Name | Sequence |
|---|---|---|---|---|
| 497 | DVD482H | AB014 | AB015 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPEVQLVESGGGL VQPGGSLRLSCAASGFTFTDNWISWVRQAPGKGLE WVGYISPNSGFTYYADSVKGRFTISADTSKNTAYL QMNSLRAEDTAVYYCARDNFGGYFDYWGQGTLVTV SS |
| 498 | DVD482L | AB014 | AB015 | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPDIQMTQSPSSLSASVGDRVT ITCRASQDVSTAVAWYQQKPGKAPKLLIYSASFLY SGVPSRFSGSGSGTDFTLTISSLQPEDFATTYYCQ QSYTGTVTFGQGTKVEIKR |

Example 2.101

Generation of VEGF (Seq. 1) and DLL4 (Seq. 3) DVD-Igs with Linker Set 1

TABLE 134

| DVD SEQ ID NO | DVD Variable Domain Name | Outer Variable Domain Name | Inner Variable Domain Name | Sequence |
|---|---|---|---|---|
| 499 | DVD487H | AB072 | AB014 | EVQLQQSGPELVKPGASVKMSCKASGYTFTSYVIN WVKQKPGQGLEWIGLINPYNDGTKYNEKEKVKATL TSDKSSSTAYMELSSLTSEDSAVYYCASYYYGSRY YFDYWGQGTTLTVSSASTKGPEVQLVESGGGLVQP GGSLRLSCAASGYTFTNYGMNWVRQAPGKGLEWVG WINTYTGEPTYAADFKRRFTFSLDTSKSTAYLQMN SLRAEDTAVYYCAKYPHYYGSSHWYFDVWGQGTLV TVSS |
| 500 | DVD487L | AB072 | AB014 | DIQMTQSSSYLSVSLGGRVTITCKASDHINNWLAW YQQKPGNAPRLLISGATSLETGVPSRFSGSGSGKD YTLSITSLQTEDVATYYCQQYWSIPLTFGAGTKLE LKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |
| 501 | DVD488H | AB014 | AB072 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPEVQLQQSGPEL VKPGASVKMSCKASGYTFTSYVINWVKQKPGQGLE WIGLINPYNDGTKYNEKFKVKATLTSDKSSSTAYM ELSSLTSEDSAVYYCASYYYGSRYYFDYWGQGTTL TVSS |
| 502 | DBD488L | AB014 | AB072 | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSSSYLSVSLGGRVTITCKASD HINNWLAWYQQKPGNAPRLLISGATSLETGVPSRF SGSGSGKDYTLSITSLQTEDVATYYCQQYWSIPLT FGAGTKLELKR |

Example 2.102

Generation of VEGF (Seq. 1) and DLL4 (Seq. 3)
DVD-Igs with Linker Set 2

TABLE 135

| DVD SEQ ID NO | Variable Domain Name | Outer Variable Domain Name | Inner Variable Domain Name | Sequence 123456789012345678901234567890123456789012345 |
|---|---|---|---|---|
| 503 | DVD493H | AB072 | AB014 | EVQLQQSGPELVKPGASVKMSCKASGYTFTSYVIN WVKQKPGQGLEWIGLINPYNDGTKYNEKFKVKATL TSDKSSSTAYMELSSLTSEDSAVYYCASYYYGSRY YFDYWGQGTTLTVSSASTKGPSVFPLAPEVQLVES GGGLVQPGGSLRLSCAASGYTFTNYGMNWVRQAPG KGLEWVGWINTYTGEPTYAADFKRRFTFSLDTSKS TAYLQMNSLRAEDTAVYYCAKYPHYYGSSHWYFDV WGQGTLVTVSS |
| 504 | DVD493L | AB072 | AB014 | DIQMTQSSSYLSVSLGGRVTITCKASDHINNWLAW YQQKPGNAPRLLISGATSLETGVPSRFSGSGSGKD YTLSITSLQTEDVATYYCQQYWSIPLTFGAGTKLE LKRTVAAPSVFIFPPDIQMTQSPSSLSASVGDRVT ITCSASQDISNYLNWYQQKPGKAPKVLIYFTSSLH SGVPSRFSGSGSGTDFTLTISSLQPEDFATYYCQQ YSTVPWTFGQGTKVEIKR |
| 505 | DVD494H | AB014 | AB072 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPEVQL QQSGPELVKPGASVKMSCKASGYTFTSYVINWVKQ KPGQGLEWIGLINPYNDGTKYNEKFKVKATLTSDK SSSTAYMELSSLTSEDSAVYYCASYYYGSRYYFDY WGQGTTLTVSS |
| 506 | DVD494L | AB014 | AB072 | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPDIQMTQSSSYLSVSLGGRVT ITCKASDHINNWLAWYQQKPGNAPRLLISGATSLE TGVPSRFSGSGSGKDYTLSITSLQTEDVATYYCQQ YWSIPLTFGAGTKLELKR |

Example 2.103

Generation of VEGF (Seq. 1) and DLL4 (Seq. 3)
DVD-Igs with Linker Set 3

TABLE 136

| DVD SEQ ID NO | Variable Domain Name | Outer Variable Domain Name | Inner Variable Domain Name | Sequence 123456789012345678901234567890123456789012345 |
|---|---|---|---|---|
| 507 | DVD499H | AB072 | AB014 | EVQLQQSGPELVKPGASVKMSCKASGYTFTSYVIN WVKQKPGQGLEWIGLINPYNDGTKYNEKFKVKATL TSDKSSSTAYMELSSLTSEDSAVYYCASYYYGSRY YFDYWGQGTTLTVSSASTKGPSVFPLAPEVQLVES GGGLVQPGGSLRLSCAASGYTFTNYGMNWVRQAPG KGLEWVGWINTYTGEPTYAADFKRRFTFSLDTSKS TAYLQMNSLRAEDTAVYYCAKYPHYYGSSHWYFDV WGQGTLVTVSS |
| 508 | DVD499L | AB072 | AB014 | DIQMTQSSSYLSVSLGGRVTITCKASDHINNWLAW YQQKPGNAPRLLISGATSLETGVPSRFSGSGSGKD YTLSITSLQTEDVATYYCQQYWSIPLTFGAGTKLE LKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |

TABLE 136-continued

| DVD SEQ ID NO | DVD Variable Domain Name | Outer Variable Domain Name | Inner Variable Domain Name | Sequence 123456789012345678901234567890123 45 |
|---|---|---|---|---|
| 509 | DVD500H | AB014 | AB072 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPEVQL QQSGPELVKPGASVKMSCKASGYTFTSYVINWVKQ KPGQGLEWIGLINPYNDGTKYNEKFKVKATLTSDK SSSTAYMELSSLTSEDSAVYYCASYYYGSRYYFDY WGQGTTLTVSS |
| 510 | DVD500L | AB014 | AB072 | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSSSYLSVSLGGRVTITCKASD HINNWLAWYQQKPGNAPRLLISGATSLETGVPSRF SGSGSGKDYTLSITSLQTEDVATYYCQQYWSIPLT FGAGTKLELKR |

Example 2.104

Generation of VEGF (Seq. 1) and DLL4 (Seq. 3) DVD-Igs with Linker Set 4

TABLE 137

| DVD SEQ ID NO | DVD Variable Domain Name | Outer Variable Domain Name | Inner Variable Domain Name | Sequence 123456789012345678901234567890123 45 |
|---|---|---|---|---|
| 511 | DVD505H | AB072 | AB014 | EVQLQQSGPELVKPGASVKMSCKASGYTFTSYVIN WVKQKPGQGLEWIGLINPYNDGTKYNEKFKVKATL TSDKSSSTAYMELSSLTSEDSAVYYCASYYYGSRY YFDYWGQGTTLTVSSASTKGPEVQLVESGGGLVQP GGSLRLSCAASGYTFTNYGMNWVRQAPGKGLEWVG WINTYTGEPTYAADFKRRFTFSLDTSKSTAYLQMN SLRAEDTAVYYCAKYPHYYGSSHWYFDVWGQGTLV TVSS |
| 512 | DVD505L | AB072 | AB014 | DIQMTQSSSYLSVSLGGRVTITCKASDHINNWLAW YQQKPGNAPRLLISGATSLETGVPSRFSGSGSGKD YTLSITSLQTEDVAIYYCQQYWSIPLTFGAGTKLE LKRTVAAPSVFIFPPDIQMTQSPSSLSASVGDRVT ITCSASQDISNYLNWYQQKPGKAPKVLIYFTSSLH SGVPSRFSGSGSGTDFTLTISSLQPEDFATYYCQQ YSTVPWTFGQGTKVEIKR |
| 513 | DVD506H | AB014 | AB072 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYRHYYGS SHWYFDVWGQGTLVTVSSASTKGPEVQLQQSGPEL VKPGASVKMSCKASGYTFTSYVINWVKQKPGQGLE WIGLINPYNDGTKYNEKFKVKATLTSDKSSSTAYM ELSSLTSEDSAVYYCASYYYGSRYYFDYWGQGTTL TVSS |
| 514 | DVD506L | AB014 | AB072 | DIQMTQSPSSLSASVGDRVTITCSASQDISNYLNW YQQKPGKAPKVLIYFTSSLHSGVRSRFSGSGSGTD FTLTISSLQPEDFATYYCQQYSTVPWTFGQGTKVE IKRTVAAPSVFIFPPDIQMTQSSSYLSVSLGGRVT ITCKASDHINNWLAWYQQKPGNAPRLLISGATSLE TGVRSRFSGSGSGKDYTLSITSLQTEDVATYYCQQ YWSIPLTFGAGTKLELKR |

Example 2.105

Generation of VEGF (Seq. 2) and DLL4 (Seq. 3)
DVD-Igs with Linker Set 1

TABLE 138

| DVD SEQ ID NO | DVD Variable Domain Name | Outer Variable Domain Name | Inner Variable Domain Name | Sequence 12345678901234567890123456789012345 |
|---|---|---|---|---|
| 515 | DVD489H | AB072 | AB070 | EVQLQQSGPELVKPGASVKMSCKASGYTFTSYVIN WVKQKPGQGLEWIGLINPYNDGTKYNEKFKVKATL TSDKSSSTAYMELSSLTSEDSAVYYCASYYYGSRY YFDYWGQGTTLTVSSASTKGPEVQLVESGGGLVQP GGSLRLSCAASGFTISDYWIHWVRQAPGKGLEWVA GITPAGGYTYYADSVKGRFTISADTSKNTAYLQMN SLRAEDTAVYYCARFVFFLPYAMDYWGQGTLVTVS S |
| 516 | DVD489L | AB072 | AB070 | DIQMTQSSSYLSVSLGGRVTITCKASDHINNWLAW YQQKPGNAPRLLISGATSLETGVPSRFSGSGSGKD YTLSITSLQTEDVATYYCQQYWSIPLTFGAGTKLE LKRTVAAPDIQMTQSPSSLSASVGDRVTITCRASQ DVSTAVAWYQQKPGKAPKLLIYSASFLYSGVPSRF SGSGSGTDFTLTISSLQPEDFATYYCQQSYTTPPT FGQGTKVEIKR |
| 517 | DVD490H | AB070 | AB072 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPEVQLQQSGPELVKP GASVKMSCKASGYTFISYVINWVKQKPGQGLEWIG LINPYNDGTKYNEKFKVKATLTSDKSSSTAYMELS SLTSEDSAVYYCASYYYGSRYYFDYWGQGTTLTVS S |
| 518 | DVD490L | AB070 | AB072 | DIQMTQSPSSLSASVGDRVTITCRASQDVSTAVAW YQQKPGKAPKLLIYSASFLYSGVPSRFSGSGSGTD FTLTISSLQPEDFAIYYCQQSYTTPPTFGQGTKVE IKRTVAAPDIQMTQSSSYLSVSLGGRVTITCKASD HINNWLAWYQQKPGNAPRLLISGAISLETGVPSRF SGSGSGKDYTLSITSLQTEDVATYYCQQYWSIPLT FGAGTKLELKR |

Example 2.106

Generation of VEGF (Seq. 2) and DLL4 (Seq. 3)
DVD-Igs with Linker Set 2

TABLE 139

| DVD SEQ ID NO | DVD Variable Domain Name | Outer Variable Domain Name | Inner Variable Domain Name | Sequence 12345678901234567890123456789012345 |
|---|---|---|---|---|
| 519 | DVD495H | AB072 | AB070 | EVQLQQSGPELVKPGASVKMSCKASGYTFTSYVIN WVKQKPGQGLEWIGLINPYNDGTKYNEKFKVKATL TSDKSSSTAYMELSSLTSEDSAVYYCASYYYGSRY YFDYWGQGTTLTVSSASTKGPSVFPLAPEVQLVES GGGLVQPGGSLRLSCAASGFTISDYWIHWVRQAPG KGLEWVAGITPAGGYTYYADSVKGRFTISADTSKN TAYLQMNSLRAEDTAVYYCARFVFFLPYAMDYWGQ GTLVTVSS |
| 520 | DVD495L | AB072 | AB070 | DIQMTQSSSYLSVSLGGRVTITCKASDHINNWLAW YQQKPGNAPRLLISGATSLETGVPSRFSGSGSGKD YTLSITSLQTEDVATYYCQQYWSIPLTFGAGTKLE LKRTVAAPSVFIFPPDIQMTQSPSSLSASVGDRVT ITCRASQDVSTAVAWYQQKPGKAPKLLIYSASFLY SGVPSRFSGSGSGTDFTLTISSLQPEDFATYYCQQ SYTTPPTFGQGTKVEIKR |

TABLE 139-continued

| DVD SEQ ID NO | DVD Variable Domain Name | Outer Variable Domain Name | Inner Variable Domain Name | Sequence |
|---|---|---|---|---|
| 521 | DVD496H | AB070 | AB072 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPEVQLQQS GPELVKPGASVKMSCKASGYTFTSYVINWVKQPG QGLEWIGLINPYNDGTKYNEKFKVKATLTSDKSSS TAYMELSSLTSEDSAVYYCASYYYGSRYYFDYWGQ GTTLTVSS |
| 522 | DVD496L | AB070 | AB072 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPSVFIFPPDIQMTQSSSYLSVSLGGRVT ITCKASDHINNWLAWYQQKPGNAPRLLISGATSLE TGVPSRFSGSGSGKDYTLSITSLQTEDVATYYCQQ YWSIPLTFGAGTKLELKR |

Example 2.107

Generation of VEGF (Seq. 2) and DLL4 (Seq. 3) DVD-Igs with Linker Set 3

TABLE 140

| DVD SEQ ID NO | DVD Variable Domain Name | Outer Variable Domain Name | Inner Variable Domain Name | Sequence |
|---|---|---|---|---|
| 523 | DVD501H | AB072 | AB070 | EVQLQQSGPELVKPGASVKMSCKASGYTFTSYVIN WVKQPGQGLEWIGLINPYNDGTKYNEKFKVKATL TSDKSSSTAYMELSSLTSEDSAVYYCASYYYGSRY YFDYWGQGTTLTVSSASTKGPSVFPLAPEVQLVES GGGLVQPGGSLRLSCAASGFTISDYWIHWVRQAPG KGLEWVAGITPAGGYTYYADSVKGRFTISADTSKN TAYLQMNSLRAEDTAVYYCARFVFFLPYAMDYWGQ GTLVTVSS |
| 524 | DVD501L | AB072 | AB070 | DIQMTQSSSYLSVSLGGRVTITCKASDHINNWLAW YQQKPGNAPRLLISGATSLETGVPSRFSGSGSGKD YTLSITSLQTEDVATYYCQQYWSIPLTFGAGTKLE LKRTVAAPDIQMTQSPSSLSASVGDRVTITCRASQ DVSTAVAWYQQKPGKAPKLLIYSASFLYSGVPSRF SGSGSGTDFTLTISSLQPEDFATYYCQQSYTTPPT FGQGTKVEIKR |
| 525 | DVD502H | AB070 | AB072 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPEVQLQQS GPELVKPGASVKMSCKASGYTFTSYVINWVKQPG QGLEWIGLINPYNDGTKYNEKFKVKATLTSDKSSS TAYMELSSLTSEDSAVYYCASYYYGSRYYFDYWGQ GTTLTVSS |
| 526 | DVD502L | AB070 | AB072 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPDIQMTQSSSYLSVSLGGRVTITCKASD HINNWLAWYQQKPGNAPRLLISGATSLETGVPSRF SGSGSGKDYTLSITSLQTEDVATYYCQQYWSIPLT FGAGTKLELKR |

Example 2.108

Generation of VEGF (Seq. 2) and DLL4 (Seq. 3)
DVD-Igs with Linker Set 4

TABLE 141

| DVD SEQ ID NO | Variable Domain Name | Outer Variable Domain Name | Inner Variable Domain Name | Sequence 12345678901234567890123456789012345 |
|---|---|---|---|---|
| 527 | DVD507H | AB072 | AB070 | EVQLQQSGPELVKPGASVKMSCKASGYTFTSYVIN WVKQKPGQGLEWIGLINPYNDGTKYNEKFKVKATL TSDKSSSTAYMELSSLTSEDSAVYYCASYYYGSRY YFDYWGQGTTLTVSSASTKGPEVQLVESGGGLVQP GGSLRLSCAASGFTISDYWIHWVRQAPGKGLEWVA GITPAGGYTYYADSVKGRFTISADTSKNTAYLQMN SLRAEDTAVYYCARFVFFLPYAMDYWGQGTLVTVS S |
| 528 | DVD507L | AB072 | AB070 | DIQMTQSSSYLSVSLGGRVTITCKASDHINNWLAW YQQKPGNAPRLLISGATSLETGVPSRFSGSGSGKD YTLSITSLQTEDVATYYCQQYWSIPLTFGAGTKLE LKRTVAAPSVFIFPPDIQMTQSPSSLSASVGDRVT ITCRASQDVSTAVAWYQQKPGKAPKLLIYSASFLY SGVPSRFSGSGSGTDFTLTISSLQPEDFATYYCQQ SYTTPPTFGQGTKVEIKR |
| 529 | DVD508H | AB070 | AB072 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPEVQLQQSGPELVKP GASVKMSCKASGYTFISYVINWVKQKPGQGLEWIG LINPYNDGTKYNEKFKVKATLTSDKSSSTAYMELS SLTSEDSAVYYCASYYYGSRYYFDYWGQGTTLTVS S |
| 530 | DVD508L | AB070 | AB072 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPSVFIFPPDIQMTQSSSYLSVSLGGRVT ITCKASDHINNWLAWYQQKPGNAPRLLISGATSLE TGVPSRFSGSGSGKDYTLSITSLQTEDVATYYCQQ YWSIPLTFGAGTKLELKR |

Example 2.109

Generation of VEGF (Seq. 3) and DLL4 (Seq. 3)
DVD-Igs with Linker Set 1

TABLE 142

| DVD SEQ ID NO | Variable Domain Name | Outer Variable Domain Name | Inner Variable Domain Name | Sequence 12345678901234567890123456789012345 |
|---|---|---|---|---|
| 531 | DVD491H | AB072 | AB071 | EVQLQQSGRELVKPGASVKMSCKASGYTFTSYVIN WVKQKRGQGLEWIGLINPYNDGTKYNEKFKVKATL TSDKSSSTAYMELSSLTSEDSAVYYCASYYYGSRY YFDYWGQGTTLTVSSASTKGPEVQLVESGGGLVQP GGSLRLSCAASGFTINASWIHWVRQAPGKGLEWVG AIYPYSGYTNYADSVKGRFTISADTSKNTAYLQMN SLRAEDTAVYYCARWGHSTSPWAMDYWGQGTLVTV SS |
| 532 | DVD491L | AB072 | AB071 | DIQMTQSSSYLSVSLGGRVTITCKASDHINNWLAW YQQKPGNAPRLLISGATSLETGVPSRFSGSGSGKD YTLSITSLQTEDVATYYCQQYWSIPLTFGAGTKLE LKRTVAAPDIQMTQSPSSLSASVGDRVTITCRASQ VIRRSLAWYQQKPGKAPKLLIYAASNLASGVPSRF SGSGSGTDFTLTISSLQPEDFATYYCQQSNTSPLT FGQGTKVEIKR |

TABLE 142-continued

| DVD SEQ ID NO | DVD Variable Domain Name | Outer Variable Domain Name | Inner Variable Domain Name | Sequence 123456789012345678901234567890123456 |
|---|---|---|---|---|
| 533 | DVD492H | AB071 | AB072 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPEVQLQQSGPELVK PGASVKMSCKASGYTFTSYVINWVKQPGQGLEWI GLINPYNDGTKYNEKFKVKATLTSDKSSSTAYMEL SSLTSEDSAVYYCASYYYGSRYYFDYWGQGTTLTV SS |
| 534 | DVD492L | AB071 | AB072 | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPDIQMTQSSSYLSVSLGGRVTITCKASD HINNWLAWYQQKPGNAPRLLISGATSLETGVPSRF SGSGSGKDYTLSITSLQTEDVATYYCQQYWSIPLT FGAGTKLELKR |

Example 2.110

Generation of VEGF (Seq. 3) and DLL4 (Seq. 3) DVD-Igs with Linker Set 2

TABLE 143

| DVD SEQ ID NO | DVD Variable Domain Name | Outer Variable Domain Name | Inner Variable Domain Name | Sequence 123456789012345678901234567890123456 |
|---|---|---|---|---|
| 535 | DVD497H | AB072 | AB071 | EVQLQQSGPELVKRGASVKMSCKASGYTFTSYVIN WVKQPGQGLEWIGLINPYNDGTKYNEKFKVKATL TSDKSSSTAYMELSSLTSEDSAVYYCASYYYGSRY YFDYWGQGTTLTVSSASTKGPSVFPLAPEVQLVES GGGLVQPGGSLRLSCAASGFTINASWIHWVRQAPG KGLEWVGAIYPYSGYTNYADSVKGRFTISADTSKN TAYLQMNSLRAEDTAVYYCARWGHSTSPWAMDYWG QGTLVTVSS |
| 536 | DVD497L | AB072 | AB071 | DIQMTQSSSYLSVSLGGRVTITCKASDHINNWLAW YQQKPGNAPRLLISGATSLETGVPSRFSGSGSGKD YTLSITSLQTEDVATYYCQQYWSIPLTFGAGTKLE LKRTVAAPSVFIFPPDIQMTQSPSSLSASVGDRVT ITCRASQVIRRSLAWYQQKPGKAPKLLIYAASNLA SGVPSRFSGSGSGTDFTLTISSLQPEDFATYYCQQ SNTSPLTFGQGTKVEIKR |
| 537 | DVD498H | AB071 | AB072 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPSVFPLAPEVQLQQ SGPELVKPGASVKMSCKASGYTFTSYVINWVKQKP GQGLEWIGLINPYNDGTKYNEKFKVKATLTSDKSS STAYMELSSLTSEDSAVYYCASYYYGSRYYFDYWG QTTILTVSS |
| 538 | DVD498L | AB071 | AB072 | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPSVFIFPPDIQMIQSSSYLSVSLGGRVT ITCKASDHINNWLAWYQQKPGNAPRLLISGATSLE TGVPSRFSGSGSGKDYTLSITSLQTEDVATYYCQQ YWSIPLTFGAGTKLELKR |

Example 2.111

Generation of VEGF (Seq. 3) and DLL4 (Seq. 3)
DVD-Igs with Linker Set 3

TABLE 144

| DVD SEQ ID NO | DVD Variable Domain Name | Outer Variable Domain Name | Inner Variable Domain Name | Sequence 123456789012345678901234567890123456789012345 |
|---|---|---|---|---|
| 539 | DVD503H | AB072 | AB071 | EVQLQQSGPELVKPGASVKMSCKASGYTFTSYVIN WVKQKPGQGLEWIGLINPYNDGTKYNEKFKVKATL TSDKSSSTAYMELSSLTSEDSAVYYCASYYYGSRY YFDYWGQGTTLTVSSASTKGPSVFPLAPEVQLVES GGGLVQRGGSLRLSCAASGFTINASWIHWVRQAPG KGLEWVGAIYPYSGYTNYADSVKGRFTISADTSKN TAYLQMNSLRAEDTAVYYCARWGHSTSPWAMDYWG QGTLVTVSS |
| 540 | DVD503L | AB072 | AB071 | DIQMTQSSSYLSVSLGGRVTITCKASDHINNWLAW YQQKPGNAPRLLISGATSLETGVPSRFSGSGSGKD YTLSITSLQTEDVATYYCQQYWSIPLTFGAGTKLE LKRTVAAPDIQMTQSPSSLSASVGDRVTITCRASQ VIRRSLAWYQQKPGKAPKLLIYAASNLASGVPSRF SGSGSGTDFTLTISSLQPEDFATYYCQQSNTSPLT FGQGTKVEIKR |
| 541 | DVD504H | AB071 | AB072 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPSVFPLAPEVQLQQ SGPELVKPGASVKMSCKASGYTFTSYVINWVKQKP GQGLEWIGLINPYNDGTKYNEKFKVKATLTSDKSS STAYMELSSLTSEDSAVYYCASYYYGSRYYFDYWG QGTTLTVSS |
| 542 | DVD504L | AB071 | AB072 | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPDIQMTQSSSYLSVSLGGRVTITCKASD HINNWLAWYQQKPGNAPRLLISGATSLETGVPSRF SGSGSGKDYTLSITSLQTEDVATYYCQQYWSIPLT FGAGTKLELKR |

Example 2.112

Generation of VEGF (Seq. 3) and DLL4 (Seq. 3)
DVD-Igs with Linker Set 4

TABLE 145

| DVD SEQ ID NO | DVD Variable Domain Name | Outer Variable Domain Name | Inner Variable Domain Name | Sequence 123456789012345678901234567890123456789012345 |
|---|---|---|---|---|
| 543 | DVD509H | AB072 | AB071 | EVQLQQSGPELVKPGASVKMSCKASGYTFTSYVIN WVKQKPGQGLEWIGLINPYNDGTKYNEKFKVKATL TSDKSSSTAYMELSSLTSEDSAVYYCASYYYGSRY YFDYWGQGTTLTVSSASTKGPEVQLVESGGGLVQP GGSLRLSCAASGFTINASWIHWVRQAPGKGLEWVG AIYPYSGYTNYADSVKGRFTISADTSKNTAYLQMN SLRAEDTAVYYCARWGHSTSPWAMDYWGQGTLVTV SS |
| 544 | DVD509L | AB072 | AB071 | DIQMTQSSSYLSVSLGGRVTITCKASDHINNWLAW YQQKPGNAPRLLISGATSLETGVPSRFSGSGSGKD YTLSITSLQTEDVATYYCQQYWSIPLTFGAGTKLE LKRTVAAPSVFIFPPDIQMTQSPSSLSASVGDRVT ITCRASQVIRRSLAWYQQKPGKAPKLLIYAASNLA SGVPSRFSGSGSGIDFTLTISSLQPEDFATYYCQQ SNTSPLTFGQGTKVEIKR |

TABLE 145-continued

| DVD SEQ ID NO | DVD Variable Domain Name | Outer Variable Domain Name | Inner Variable Domain Name | Sequence 123456789012345678901234567890 12345 |
|---|---|---|---|---|
| 545 | DVD510H | AB071 | AB072 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPEVQLQQSGPELVK PGASVKMSCKASGYTFTSYVINWVKQPGQGLEWI GLINPYNDGTKYNEKFKVKATLTSDKSSSTAYMEL SSLTSEDSAVYYCASYYYGSRYYFDYWGQGTTLTV SS |
| 546 | DVD510L | AB071 | AB072 | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPSVFIFPPDIQMTQSSSYLSVSLGGRVT ITCKASDHINNWLAWYQQKPGNAPRLLISGATSLE TGVPSRFSGSGSGKDYTLSITSLQTEDVATYYCQQ YWSIPLTFGAGTKLELKR |

Example 2.113

Generation of VEGF (Seq. 1) and DLL4 (Seq. 4) DVD-Igs with Linker Set 1

TABLE 146

| DVD SEQ ID NO | DVD Variable Domain Name | Outer Variable Domain Name | Inner Variable Domain Name | Sequence 123456789012345678901234567890 12345 |
|---|---|---|---|---|
| 547 | DVD511H | AB073 | AB014 | EVQLQQSGPELEKPGASVKISCKASGYSFTGYNMN WVKQSNGKSLEWIGNIDRYFGGTNYNQKFKGKATL TVDKSSSTAYMQLKSLTSEDSAVYYCARNYDYDGG CFDYWGQGTTLTVSSASTKGPEVQLVESGGGLVQP GGSLRLSCAASGYTFTNYGMNWVRQARGKGLEWVG WINTYTGEPTYAADFKRRFTFSLDTSKSTAYLQMN SLRAEDTAVYYCAKYPHYYGSSHWYFDVWGQGTLV TVSS |
| 548 | DVD511L | AB073 | AB014 | QAVVTQESALTTSPGETVTLTCRSSTGAVTTSNYA NWVQEKPDHLFTGLIGGTNNRAPGVPARFSGSLIG DKAALTITGAQTEDEAIYFCALWYSNHWVFGGGTK LTVLGQPKAAPDIQMTQSPSSLSASVGDRVTITCS ASQDISNYLNWYQQKRGKAPKVLIYFTSSLHSGVP SRFSGSGSGTDFTLTISSLQREDFATYYCQQYSTV PWTFGQGTKVEIKR |
| 549 | DVD512H | AB014 | AB073 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPEVQLQQSGPEL EKPGASVKISCKASGYSFTGYNMNWVKQSNGKSLE WIGNIDPYFGGTNYNQKFKGKATLTVDKSSSTAYM QLKSLTSEDSAVYYCARNYDYDGGCFDYWGQGTTL TVSS |
| 550 | DVD512L | AB014 | AB073 | DIQMTQSPSSLSASVGDRVTITCSASQDISNYLNW YQQKPGKAPKVLIYFTSSLHSGVRSRFSGSGSGTD FTLTISSLQREDFATYYCQQYSTVRWTFGQGTKVE IKRTVAAPQAVVTQESALTTSPGETVTLTCRSSTG AVTTSNYANWVQEKPDHLFTGLIGGTNNRAPGVPA RFSGSLIGDKAALTITGAQTEDEAIYFCALWYSNH WVFGGGTKLTVLG |

Example 2.114

Generation of VEGF (Seq. 1) and DLL4 (Seq. 4)
DVD-Igs with Linker Set 2

TABLE 147

| DVD SEQ ID NO | Variable Domain Name | Outer Variable Domain Name | Inner Variable Domain Name | Sequence 123456789012345678901234567890123456789012345 |
|---|---|---|---|---|
| 551 | DVD517H | AB073 | AB014 | EVQLQQSGPELEKPGASVKISCKASGYSFTGYNMN WVKQSNGKSLEWIGNIDPYFGGTNYNQKFKGKATL TVDKSSSTAYMQLKSLTSEDSAVYYCARNYDYDGG CFDYWGQGTTLTVSSASTKGPSVFPLAPEVQLVES GGGLVQRGGSLRLSCAASGYTFTNYGMNWVRQAPG KGLEWVGWINTYTGEPTYAADFKRRFTFSLDTSKS TAYLQMNSLRAEDTAVYYCAKYPHYYGSSHWYFDV WGQGTLVTVSS |
| 552 | DVD517L | AB073 | AB014 | QAVVTQESALTTSPGETVTLTCRSSTGAVTTSNYA NWVQEKPDHLFTGLIGGTNNRAPGVRAPFSGSLIG DKAALTITGAQTEDEAIYFCALWYSNHWVFGGGTK LTVLGQPKAAPSVTLFPPDIQMTQSRSSLSASVGD RVTITCSASQDISNYLNWYQQKPGKAPKVLIYFTS SLHSGVRSRFSGSGSGTDFTLTISSLQPEDFATYY CQQYSTVRWTFGQGTKVEIKR |
| 553 | DVD518H | AB014 | AB073 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPEVQL QQSGPELEKPGASVKISCKASGYSFTGYNMNWVKQ SNGKSLEWIGNIDPYFGGTNYNQKFKGKATLTVDK SSSTAYMQLKSLTSEDSAVYYCARNYDYDGGCFDY WGQGTTLTVSS |
| 554 | DVD518L | AB014 | AB073 | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPQAVVTQESALTTSPGETVTL TCRSSTGAVTTSNYANWVQEKPDHLFTGLIGGTNN RAPGVPARFSGSLIGDKAALTITGAQTEDEAIYFC ALWYSNHWVFGGGTKLTVLG |

Example 2.115

Generation of VEGF (Seq. 1) and DLL4 (Seq. 4)
DVD-Igs with Linker Set 3

TABLE 148

| DVD SEQ ID NO | Variable Domain Name | Outer Variable Domain Name | Inner Variable Domain Name | Sequence 123456789012345678901234567890123456789012345 |
|---|---|---|---|---|
| 555 | DVD523H | AB073 | AB014 | EVQLQQSGPELEKPGASVKISCKASGYSFTGYNMN WVKQSNGKSLEWIGNIDPYFGGTNYNQKFKGKATL TVDKSSSTAYMQLKSLTSEDSAVYYCARNYDYDGG CFDYWGQGTTLTVSSASTKGPSVFPLAPEVQLVES GGGLVQPGGSLRLSCAASGYTFTNYGMNWVRQAPG KGLEWVGWINTYTGEPTYAADFKRRFTFSLDTSKS TAYLQMNSLRAEDTAVYYCAKYPHYYGSSHWYFDV WGQGTLVTVSS |
| 556 | DVD523L | AB073 | AB014 | QAVVTQESALTTSPGETVTLTCRSSTGAVTTSNYA NWVQEKPDHLFTGLIGGTNNRAPGVPARFSGSLIG DKAALTITGAQTEDEAIYFCALWYSNHWVFGGGTK LTVLGQPKAAPDIQMTQSPSSLSASVGDRVTITCS ASQDISNYLNWYQQKPGKAPKVLIYFTSSLHSGVP SRFSGSGSGTDFTLTISSLQPEDFATYYCQQYSTV PWTFGQGTKVEIKR |

TABLE 148-continued

| DVD SEQ ID NO | DVD Variable Domain Name | Outer Variable Domain Name | Inner Variable Domain Name | Sequence 123456789012345678901234567890123456789012345 |
|---|---|---|---|---|
| 557 | DVD524H | AB014 | AB073 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPEVQL QQSGPELEKPGASVKISCKASGYSFTGYNMNWVKQ SNGKSLEWIGNIDPYFGGTNYNQKFKGKATLTVDK SSSTAYMQLKSLTSEDSAVYYCARNYDYDGGCFDY WGQGTTLTVSS |
| 558 | DVD524L | AB014 | AB073 | DIQMTQSPSSLSASVGDRVTITCSASQDISNYLNW YQQKPGKAPKVLIYFTSSLHSGVPSRFSGSGSGTD FTLTISSLQPEDFATYYCQQYSTVRWTFGQGTKVE IKRTVAAPQAVVTQESALTTSPGETVTLTCRSSTG AVTTSNYANWVQEKPDHLFTGLIGGTNNRAPGVPA RFSGSLIGDKAALTITGAQIEDEAIYFCALWYSNH WVFGGGTKLTVLG |

Example 2.116

Generation of VEGF (Seq. 1) and DLL4 (Seq. 4) DVD-Igs with Linker Set 4

TABLE 149

| DVD SEQ ID NO | DVD Variable Domain Name | Outer Variable Domain Name | Inner Variable Domain Name | Sequence 123456789012345678901234567890123456789012345 |
|---|---|---|---|---|
| 559 | DVD529H | AB073 | AB014 | EVQLQQSGPELEKPGASVKISCKASGYSFTGYNMN WVKQSNGKSLEWIGNIDPYFGGTNYNQKFKGKATL TVDKSSSTAYMQLKSLTSEDSAVYYCARNYDYDGG CFDYWGQGTTLTVSSASTKGPEVQLVESGGGLVQP GGSLRLSCAASGYTFTNYGMNWVRQAPGKGLEWVG WINTYTGEPTYAADFKRRFTFSLDTSKSTAYLQMN SLRAEDTAVYYCAKYPHYYGSSHWYFDVWGQGTLV TVSS |
| 560 | DVD529L | AB073 | AB014 | QAVVTQESALTTSRGETVTLTCRSSTGAVTTSNYA NWVQEKPDHLFTGLIGGTNNRAPGVPARFSGSLIG DKAALTITGAQTEDEAIYFCALWYSNHWVFGGGTK LTVLGQPKAAPSVTLFPPDIQMTQSPSSLSASVGD RVTITCSASQDISNYLNWYQQKPGKAPKVLIYFTS SLHSGVPSRFSGSGSGTDFTLTISSLQPEDFATYY CQQYSTVPWTFGQGTKVEIKR |
| 561 | DVD530H | AB014 | AB073 | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLTIVSSASTKGPEVQLQQSGPEL EKRGASVKISCKASGYSFTGYNMNWVKQSNGKSLE WIGNIDPYFGGTNYNQKFKGKATLTVDKSSSTAYM QLKSLTSEDSAVYYCARNYDYDGGCFDYWGQGTTL TVSS |
| 562 | DVD530L | AB014 | AB073 | DIQMTQSRSSLSASVGDRVTITCSASQDISNYLNW YQQKPGKAPKVLIYFTSSLHSGVRSRFSGSGSGTD FTLTISSLQPEDFATYYCQQYSTVRWTFGQGTKVE IKRTVAAPSVFIFPPQAVVTQESALTTSPGETVTL TCRSSTGAVTTSNYANWVQEKPDHLFTGLIGGTNN RAPGVPARFSGSLIGDKAALTITGAQTEDEAIYFC ALWYSNHWVFGGGTKLTVLG |

Example 2.117

Generation of VEGF (Seq. 2) and DLL4 (Seq. 4)
DVD-Igs with Linker Set 1

TABLE 150

| DVD SEQ ID NO | Outer Variable Domain Name | Inner Variable Domain Name | Sequence 123456789012345678901234567890123456789012345 |
|---|---|---|---|
| 563 DVD513H | AB073 | AB070 | EVQLQQSGPELEKPGASVKISCKASGYSFTGYNMN WVKQSNGKSLEWIGNIDPYFGGTNYNQKFKGKATL TVDKSSSTAYMQLKSLTSEDSAVYYCARNYDYDGG CFDYWGQGTTLTVSSASTKGPEVQLVESGGGLVQP GGSLRLSCAASGFTISDYWIHWVRQAPGKGLEWVA GITPAGGYTYYADSVKGRFTISADTSKNTAYLQMN SLRAEDTAVYYCARFVFFLPYAMDYWGQGTLVTVS S |
| 564 DVD513L | AB073 | AB070 | QAVVTQESALTTSPGETVTLTCRSSTGAVTTSNYA NWVQEKPDHLFTGLIGGTNNRAPGVPARFSGSLIG DKAALTITGAQTEDEAIYFCALWYSNHWVFGGGTK LTVLGQPKAAPDIQMTQSPSSLSASVGDRVTITCR ASQDVSTAVAWYQQKPGKAPKLLIYSASFLYSGVP SRFSGSGSGTDFTLTISSLQPEDFATYYCQQSYTT PPTFGQGTKVEIKR |
| 565 DVD514H | AB070 | AB073 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPEVQLQQSGPELEKP GASVKISCKASGYSFTGYNMNWVKQSNGKSLEWIG NIDPYFGGTNYNQKFKGKATLTVDKSSSTAYMQLK SLTSEDSAVYYCARNYDYDGGCFDYWGQGTTLTVS S |
| 566 DVD514L | AB070 | AB073 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPQAVVTQESALTTSPGETVTLTCRSSTG AVTTSNYANWVQEKPDHLFTGLIGGTNNRAPGVPA RFSGSLIGDKAALTITGAQTEDEAIYFCALWYSNH WVFGGGTKLTVLG |

Example 2.118

Generation of VEGF (Seq. 2) and DLL4 (Seq. 4)
DVD-Igs with Linker Set 2

TABLE 151

| DVD SEQ ID NO | Outer Variable Domain Name | Inner Variable Domain Name | Sequence 123456789012345678901234567890123456789012345 |
|---|---|---|---|
| 567 DVD519H | AB073 | AB070 | EVQLQQSGPELEKPGASVKISCKASGYSFTGYNMN WVKQSNGKSLEWIGNIDPYFGGTNYNQKFKGKATL TVDKSSSTAYMQLKSLTSEDSAVYYCARNYDYDGG CFDYWGQGTTLTVSSASTKGPSVFPLAPEVQLVES GGGLVQPGGSLRLSCAASGFTISDYWIHWVRQAPG KGLEWVAGITPAGGYTYYADSVKGRFTISADTSKN TAYLQMNSLRAEDTAVYYCARFVEFLPYAMDYWGQ GTLVTVSS |
| 568 DVD519L | AB073 | AB070 | QAVVTQESALTTSPGETVTLTCRSSTGAVTTSNYA NWVQEKPDHLFTGLIGGTNNRAPGVPARFSGSLIG DKAALTITGAQTEDEAIYFCALWYSNHWVFGGGTK LTVLGQPKAAPSVTLFPPDIQMTQSPSSLSASVGD RVTITCRASQDVSTAVAWYQQKPGKAPKLLIYSAS FLYSGVPSRFSGSGSGTDFTLTISSLQPEDFATYY CQQSYTTPPTFGQGTKVEIKR |

TABLE 151-continued

| DVD SEQ ID NO | DVD Variable Domain Name | Outer Variable Domain Name | Inner Variable Domain Name | Sequence 123456789012345678901234567890012345 |
|---|---|---|---|---|
| 569 | DVD520H | AB070 | AB073 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPEVQLQQS GPELEKPGASVKISCKASGYSFTGYNMNWVKQSNG KSLEWIGNIDPYFGGTNYNQKFKGKATLTVDKSSS TAYMQLKSLTSEDSAVYYCARNYDYDGGCFDYWGQ GTTLTVSS |
| 570 | DVD520L | AB070 | AB073 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPSVFIFPPQAVVTQESALTTSPGETVTL TCRSSTGAVTTSNYANWVQEKPDHLFTGLIGGTNN RAPGVPARFSGSLIGDKAALTITGAQTEDEAIYFC ALWYSNHWVFGGGTKLTVLG |

Example 2.119

Generation of VEGF (Seq. 2) and DLL4 (Seq. 4) DVD-Igs with Linker Set 3

TABLE 152

| DVD SEQ ID NO | DVD Variable Domain Name | Outer Variable Domain Name | Inner Variable Domain Name | Sequence 123456789012345678901234567890012345 |
|---|---|---|---|---|
| 571 | DVD525H | AB073 | AB070 | EVQLQQSGPELEKPGASVKISCKASGYSFTGYNMN WVKQSNGKSLEWIGNIDPYFGGTNYNQKFKGKATL TVDKSSSTAYMQLKSLISEDSAVYYCARNYDYDGG CFDYWGQGTTLTVSSASTKGPSVFPLAPEVQLVES GGGLVQPGGSLRLSCAASGFTISDYWIHWVRQAPG KGLEWVAGITPAGGYTYYADSVKGRFTISADTSKN TAYLQMNSLRAEDTAVYYCARFVFFLPYAMDYWGQ GTLVTVSS |
| 572 | DVD525L | AB073 | AB070 | QAVVTQESALTTSPGETVTLTCRSSTGAVTTSNYA NWVQEKPDHLFTGLIGGTNNRAPGVPARFSGSLIG DKAALTITGAQTEDEAIYFCALWYSNHWVFGGGTK LTVLGQPKAAPDIQMTQSPSSLSASVGDRVTITCR ASQDVSTAVAWYQQKPGKAPKLLIYSASFLYSGVP SRFSGSGSGTDFTLTISSLQPEDFATYYCQQSYTT PPTFGQGTKVEIKR |
| 573 | DVD526H | AB070 | AB073 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPEVQLQQS GPELEKPGASVKISCKASGYSFTGYNMNWVKQSNG KSLEWIGNIDPYFGGTNYNQKFKGKATLTVDKSSS TAYMQLKSLTSEDSAVYYCARNYDYDGGCFDYWGQ GTTLTVSS |
| 574 | DVD526L | AB070 | AB073 | DIQMTQSPSSLSASVGDRVTITCRASQDVSTAVAW YQQKPGKAPKLLIYSASFLYSGVPSRFSGSGSGTD FTLTISSLQPEDFAIYYCQQSYTTPPTFGQGTKVE IKRTVAAPQAVVTQESALTTSPGETVTLTCRSSTG AVTTSNYANWVQEKPDHLFTGLIGGTNNRAPGVPA RFSGSLIGDKAALTITGAQTEDEAIYFCALWYSNH WVFGGGTKLTVLG |

Example 2.120

Generation of VEGF (Seq. 2) and DLL4 (Seq. 4) DVD-Igs with Linker Set 4

TABLE 153

| DVD SEQ ID NO | Variable Domain Name | Outer Variable Domain Name | Inner Variable Domain Name | Sequence 123456789012345678901234567890123456789012345 |
|---|---|---|---|---|
| 575 | DVD531H | AB073 | AB070 | EVQLQQSGPELEKPGASVKISCKASGYSFTGYNMN WVKQSNGKSLEWIGNIDPYFGGTNYNQKFKGKATL TVDKSSSTAYMQLKSLTSEDSAVYYCARNYDYDGG CFDYWGQGTTLTVSSASTKGPEVQLVESGGGLVQP GGSLRLSCAASGFTISDYWIHWVRQAPGKGLEWVA GITPAGGYTYYADSVKGRFTISADTSKNTAYLQMN SLRAEDTAVYYCARFVFFLPYAMDYWGQGTLVTVS S |
| 576 | DVD531L | AB073 | AB070 | QAVVTQESALTTSPGETVTLTCRSSTGAVTTSNYA NWVQEKPDHLFTGLIGGTNNRAPGVPARFSGSLIG DKAALTITGAQTEDEAIYFCALWYSNHWVFGGGTK LTVLGQPKAAPSVTLFPPDIQMTQSPSSLSASVGD RVTITCRASQDVSTAVAWYQQKPGKAPKLLIYSAS FLYSGVPSRFSGSGSGTDFTLTISSLQPEDFATYY CQQSYTTPPTFGQGTKVEIKR |
| 577 | DVD532H | AB070 | AB073 | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPEVQLQQSGPELEKP GASVKISCKASGYSFTGYNMNWVKQSNGKSLEWIG NIDPYFGGTNYNQKFKGKATLTVDKSSSTAYMQLK SLTSEDSAVYYCARNYDYDGGCFDYWGQGTTLTVS S |
| 578 | DVD532L | AB070 | AB073 | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPSVFIFPPQAVVTQESALTTSPGETVTL TCRSSTGAVTTSNYANWVQEKPDHLFTGLIGGTNN RAPGVPARFSGSLIGDKAALTITGAQTEDEAIYFC ALWYSNHWVFGGGTKLTVLG |

Example 2.121

Generation of VEGF (Seq. 3) and DLL4 (Seq. 4) DVD-Igs with Linker Set 1

TABLE 154

| DVD SEQ ID NO | Variable Domain Name | Outer Variable Domain Name | Inner Variable Domain Name | Sequence 123456789012345678901234567890123456789012345 |
|---|---|---|---|---|
| 579 | DVD515H | AB073 | AB071 | EVQLQQSGPELEKPGASVKISCKASGYSFTGYNMN WVKQSNGKSLEWIGNIDPYFGGTNYNQKFKGKATL TVDKSSSTAYMQLKSLTSEDSAVYYCARNYDYDGG CFDYWGQGTTLTVSSASTKGPEVQLVESGGGLVQP GGSLRLSCAASGFTINASWIHWVRQAPGKGLEWVG AIYPYSGYTNYADSVKGRFTISADTSKNTAYLQMN SLRAEDTAVYYCARWGHSTSPWAMDYWGQGTLVTV SS |
| 580 | DVD515L | AB073 | AB071 | QAVVTQESALTTSPGETVTLTCRSSTGAVTTSNYA NWVQEKPDHLFTGLIGGTNNRAPGVPARFSGSLIG DKAALTITGAQTEDEAIYFCALWYSNHWVFGGGTK LTVLGQPKAAPDIQMTQSPSSLSASVGDRVTITCR ASQVIRRSLAWYQQKPGKAPKLLIYAASNLASGVP SRFSGSGSGTDFTLTISSLQPEDFATYYCQQSNTS PLTFGQGTKVEIKR |

TABLE 154-continued

| DVD SEQ ID NO | Variable Domain Name | Outer Variable Domain Name | Inner Variable Domain Name | Sequence 123456789012345678901234567890123456789012345 |
|---|---|---|---|---|
| 581 | DVD516H | AB071 | AB073 | EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPEVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSS |
| 582 | DVD516L | AB071 | AB073 | DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPQAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG |

Example 2.122

Generation of VEGF (Seq. 3) and DLL4 (Seq. 4) DVD-Igs with Linker Set 2

TABLE 155

| DVD SEQ ID NO | Variable Domain Name | Outer Variable Domain Name | Inner Variable Domain Name | Sequence 123456789012345678901234567890123456789012345 |
|---|---|---|---|---|
| 583 | DVD521H | AB073 | AB071 | EVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSSASTKGPSVFPLAPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS |
| 584 | DVD521L | AB073 | AB071 | QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGQPKAAPSVTLFPPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR |
| 585 | DVD522H | AB071 | AB073 | EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPEVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSS |
| 586 | DVD522L | AB071 | AB073 | DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPQAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG |

Example 2.123

Generation of VEGF (Seq. 3) and DLL4 (Seq. 4)
DVD-Igs with Linker Set 3

TABLE 156

| DVD SEQ ID NO | Variable Domain Name | Outer Variable Domain Name | Inner Variable Domain Name | Sequence 12345678901234567890123456789012345 |
|---|---|---|---|---|
| 587 | DVD527H | AB073 | AB071 | EVQLQQSGPELEKPGASVKISCKASGYSFTGYNMN WVKQSNGKSLEWIGNIDPYFGGTNYNQKFKGKATL TVDKSSSTAYMQLKSLTSEDSAVYYCARNYDYDGG CFDYWGQGTTLTVSSASTKGPSVFPLAPEVQLVES GGGLVQPGGSLRLSCAASGFTINASWIHWVRQAPG KGLEWVGAIYPYSGYTNYADSVKGRFTISADTSKN TAYLQMNSLRAEDTAVYYCARWGHSTSPWAMDYWG QGTLVTVSS |
| 588 | DVD527L | AB073 | AB071 | QAVVTQESALTTSPGETVTLTCRSSTGAVTTSNYA NWVQEKPDHLFTGLIGGTNNRAPGVPARFSGSLIG DKAALTITGAQTEDEAIYFCALWYSNHWVFGGGTK LTVLGQPKAAPDIQMTQSPSSLSASVGDRVTITCR ASQVIRRSLAWYQQKPGKAPKLLIYAASNLASGVP SRFSGSGSGTDFTLTISSLQPEDFATYYCQQSNTS PLTFGQGTKVEIKR |
| 589 | DVD528H | AB071 | AB073 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPSVFPLAPEVQLQQ SGPELEKPGASVKISCKASGYSFTGYNMNWVKQSN GKSLEWIGNIDPYFGGTNYNQKFKGKATLTVDKSS STAYMQLKSLTSEDSAVYYCARNYDYDGGCFDYWG QGTTLTVSS |
| 590 | DVD528L | AB071 | AB073 | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPQAVVTQESALTTSPGETVTLTCRSSTG AVTTSNYANWVQEKPDHLFTGLIGGTNNRAPGVPA RFSGSLIGDKAALTITGAQTEDEAIYFCALWYSNH WVFGGGTKLTVLG |

Example 2.124

Generation of VEGF (Seq. 3) and DLL4 (Seq. 4)
DVD-Igs with Linker Set 4

TABLE 157

| DVD SEQ ID NO | Variable Domain Name | Outer Variable Domain Name | Inner Variable Domain Name | Sequence 12345678901234567890123456789012345 |
|---|---|---|---|---|
| 591 | DVD533H | AB073 | AB071 | EVQLQQSGPELEKPGASVKISCKASGYSFTGYNMN WVKQSNGKSLEWIGNIDPYFGGTNYNQKFKGKATL TVDKSSSTAYMQLKSLTSEDSAVYYCARNYDYDGG CFDYWGQGTTLTVSSASTKGPEVQLVESGGGLVQP GGSLRLSCAASGFTINASWIHWVRQAPGKGLEWVG AIYPYSGYTNYADSVKGRFTISADTSKNTAYLQMN SLRAEDTAVYYCARWGHSTSPWAMDYWGQGTLVTV SS |
| 592 | DVD533L | AB073 | AB071 | QAVVTQESALTTSPGETVTLTCRSSTGAVTTSNYA NWVQEKPDHLFTGLIGGTNNRAPGVPARFSGSLIG DKAALTITGAQTEDEAIYFCALWYSNHWVFGGGTK LTVLGQPKAAPSVTLFPPDIQMTQSPSSLSASVGD RVTITCRASQVIRRSLAWYQQKPGKAPKLLIYAAS NLASGVPSRFSGSGSGTDFTLTISSLQPEDFATYY CQQSNTSPLTFGQGTKVEIKR |

TABLE 157-continued

| DVD SEQ ID NO | Outer Variable Domain Name | Inner Variable Domain Name | Sequence 123456789012345678901234567890123456789012345 |
|---|---|---|---|
| 593 DVD534H | AB071 | AB073 | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPEVQLQQSGPELEK PGASVKISCKASGYSFTGYNMNWVKQSNGKSLEWI GNIDPYFGGTNYNQKFKGKATLTVDKSSSTAYMQL KSLTSEDSAVYYCARNYDYDGGCFDYWGQGTTLTV SS |
| 594 DVD534L | AB071 | AB073 | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPSVFIFPPQAVVTQESALTTSPGETVTL TCRSSTGAVTTSNYANWVQEKPDHLFTGLIGGTNN RAPGVPARFSGSLIGDKAALTITGAQIEDEAIYFC ALWYSNHWVFGGGTKLTVLG |

Example 2.125

Generation of HER2 (Seq. 1) and ErbB3 (Seq. 1) DVD-Igs with Linker Set 1

TABLE 158

| DVD SEQ ID NO | Outer Variable Domain Name | Inner Variable Domain Name | Sequence 123456789012345678901234567890123456789012345 |
|---|---|---|---|
| 595 DVD387H | AB062 | AB004 | QVQLQQWGAGLLKPSETLSLTCAVYGGSFSGYYWS WIRQRRGKGLEWIGEINHSGSTNYNRSLKSRVTIS VETSKNQFSLKLSSVTAADTAVYYCARDKWTWYFD LWGRGTLVTVSSASTKGPSVFPLAPEVQLVESGGG LVQRGGSLRLSCAASGFNIKDTYIHWVRQAPGKGL EWVARIYPTNGYTRYADSVKGRFTISADTSKNTAY LQMNSLRAEDTAVYYCSRWGGDGFYAMDYWGQGTL VTVSS |
| 596 DVD387L | AB062 | AB004 | DIEMTQSPDSLAVSLGERATINCRSSQSVLYSSSN RNYLAWYQQNPGQPPKLLIYWASTRESGVRDRFSG SGSGTDETLTISSLQAEDVAVYYCQQYYSTRRTFG QGTKVEIKRTVAAPSVFIFPPDIQMTQSPSSLSAS VGDRVTITCRASQDVNTAVAWYQQKPGKAPKLLIY SASFLYSGVPSRFSGSRSGIDFTLTISSLQPEDFA TYYCQQHYTTPPTFGQGTKVEIKR |
| 597 DVD388H | AB004 | AB062 | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPSVFPLAPQVQLQQW GAGLLKPSETLSLTCAVYGGSFSGYYWSWIRQPPG KGLEWIGEINHSGSTNYNPSLKSRVTISVETSKNQ FSLKLSSVTAADTAVYYCARDKWTWYFDLWGRGTL VTVSS |
| 598 DVD388L | AB004 | AB062 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPSVFIFPPDIEMTQSPDSLAVSLGERAT INCRSSQSVLYSSSNRNYLAWYQQNPGQPPKLLIY WASTRESGVRDRFSGSGSGTDFTLTISSLQAEDVA VYYCQQYYSTPRTFGQGTKVEIKR |

Example 2.126

Generation of HER2 (Seq. 1) and ErbB3 (Seq. 1)
DVD-Igs with Linker Set 2

TABLE 159

| DVD SEQ ID NO | DVD Variable Domain Name | Outer Variable Domain Name | Inner Variable Domain Name | Sequence 123456789012345678901234567890122345 |
|---|---|---|---|---|
| 599 | DVD391H | AB062 | AB004 | QVQLQQWGAGLLKPSETLSLTCAVYGGSESGYYWS WIRQPPGKGLEWIGEINHSGSTNYNPSLKSRVTIS VETSKNQFSLKLSSVTAADTAVYYCARDKWTYFD LWGRGTLVTVSSASTKGPSVFPLAPEVQLVESGGG LVQPGGSLRLSCAASGFNIKDIYIHWVRQAPGKGL EWVARIYPINGYTRYADSVKGRFTISADTSKNTAY LQMNSLRAEDTAVYYCSRWGGDGFYAMDYWGQGTL VTVSS |
| 600 | DVD391L | AB062 | AB004 | DIEMTQSPDSLAVSLGERATINCRSSQSVLYSSSN RNYLAWYQQNPGQPPKLLIYWASTRESGVPDRFSG SGSGTDFTLTISSLQAEDVAVYYCQQYYSTPRTFG QGTKVEIKRTVAAPDIQMTQSPSSLSASVGDRVTI TCRASQDVNTAVAWYQQKPGKAPKLLIYSASFLYS GVPSRFSGSRSGTDFTLTISSLQPEDFATYYCQQH YTTPPTFGQGTKVEIKR |
| 601 | DVD392H | AB004 | AB062 | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPSVFPLAPQVQLQQW GAGLLKPSETLSLTCAVYGGSFSGYYWSWIRQPPG KGLEWIGEINHSGSTNYNPSLKSRVTISVETSKNQ FSLKLSSVTAADTAVYYCARDKWTYFDLWGRGTL VTVSS |
| 602 | DVD392L | AB004 | AB062 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPDIEMTQSPDSLAVSLGERATINCRSSQ SVLYSSSNRNYLAWYQQNPGQPPKLLIYWASTRES GVPDRFSGSGSGTDFTLTISSLQAEDVAVYYCQQY YSTPRTFGQGTKVEIKR |

Example 2.127

Generation of HER2 (Seq. 1) and ErbB3 (Seq. 1)
DVD-Igs with Linker Set 3

TABLE 160

| DVD SEQ ID NO | DVD Variable Domain Name | Outer Variable Domain Name | Inner Variable Domain Name | Sequence 123456789012345678901234567890122345 |
|---|---|---|---|---|
| 603 | DVD395H | AB062 | AB004 | QVQLQQWGAGLLKPSETLSLTCAVYGGSFSGYYWS WIRQPPGKGLEWIGEINHSGSTNYNPSLKSRVTIS VETSKNQFSLKLSSVTAADTAVYYCARDKWTYFD LWGRGTLVTVSSASTKGPEVQLVESGGGLVQPGGS LRLSCAASGFNIKDTYIHWVRQAPGKGLEWVARIY PTNGYTRYADSVKGRFTISADTSKNTAYLQMNSLR AEDTAVYYCSRWGGDGFYAMDYWGQGTLVTVSS |
| 604 | DVD395L | AB062 | AB004 | DIEMTQSPDSLAVSLGERATINCRSSQSVLYSSSN RNYLAWYQQNPGQPPKLLIYWASTRESGVPDRFSG SGSGTDFTLTISSLQAEDVAVYYCQQYYSTPRTFG QGTKVEIKRTVAAPSVFIFPPDIQMTQSPSSLSAS VGDRVTITCRASQDVNTAVAWYQQKRGKAPKLLIY SASFLYSGVPSRFSGSRSGTDFTLTISSLQPEDFA TYYCQQHYTTPPTFGQGTKVEIKR |

TABLE 160-continued

| DVD SEQ ID NO | Outer Variable Domain Name | Inner Variable Domain Name | Sequence |
|---|---|---|---|
| 605 DVD396H | AB004 | AB062 | EVQLVESGGGLVQPGGSLRLSCAASGFNIKDIYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPQVQLQQWGAGLLKP SETLSLTCAVYGGSFSGYYWSWIRQPPGKGLEWIG EINHSGSTNYNPSLKSRVTISVETSKNQFSLKLSS VTAADTAVYYCARDKWTWYFDLWGRGTLVTVSS |
| 606 DVD396L | AB004 | AB062 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPSVFIFPPDIEMTQSRDSLAVSLGERAT INCRSSQSVLYSSSNRNYLAWYQQNPGQPPKLLIY WASTRESGVPDRFSGSGSGTDFTLTISSLQAEDVA VYYCQQYYSTPRTFGQGTKVEIKR |

Example 2.128

Generation of HER2 (Seq. 1) and ErbB3 (Seq. 1) DVD-Igs with Linker Set 4

TABLE 161

| DVD SEQ ID NO | Outer Variable Domain Name | Inner Variable Domain Name | Sequence |
|---|---|---|---|
| 607 DVD683H | AB062 | AB004 | QVQLQQWGAGLLKPSETLSLTCAVYGGSFSGYYWS WIRQPPGKGLEWIGEINHSGSTNYNRSLKSRVTIS VETSKNQFSLKLSSVTAADTAVYYCARDKWTWYFD LWGRGTLVTVSSASTKGPEVQLVESGGGLVQPGGS LRLSCAASGFNIKDTYIHWVRQAPGKGLEWVARIY PTNGYTRYADSVKGRFTISADTSKNTAYLQMNSLR AEDTAVYYCSRWGGDGFYAMDYWGQGTLVTVSS |
| 608 DVD683L | AB062 | AB004 | DIEMTQSPDSLAVSLGERATINCRSSQSVLYSSSN RNYLAWYQQNPGQPPKLLIYWASTRESGVRDRFSG SGSGTDFTLTISSLQAEDVAVYYCQQYYSTRRTFG QGTKVEIKRTVAAPDIQMTQSRSSLSASVGDRVTI TCRASQDVNTAVAWYQQKPGKAPKLLIYSASFLYS GVPSRFSGSRSGTDFTLTISSLQPEDFATYYCQQH YTTPPTFGQGTKVEIKR |
| 609 DVD684H | AB004 | AB062 | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPQVQLQQWGAGLLKP SETLSLTCAVYGGSFSGYYWSWIRQPPGKGLEWIG EINHSGSTNYNPSLKSRVTISVETSKNQFSLKLSS VTAADTAVYYCARDKWTWYFDLWGRGTLVTVSS |
| 610 DVD684L | AB004 | AB062 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPDIEMTQSPDSLAVSLGERATINCRSSQ SVLYSSSNRNYLAWYQQNPGQPPKLLIYWASTRES GVPDRFSGSGSGTDFTLTISSLQAEDVAVYYCQQY YSTPRTFGQGTKVEIKR |

Example 2.129

Generation of HER2 (Seq. 1) and ErbB3 (Seq. 2) DVD-Igs with Linker Set 1

TABLE 162

| DVD SEQ ID NO | Variable Domain Name | Outer Variable Domain Name | Inner Variable Domain Name | Sequence 123456789012345678901234567890123456789012345 |
|---|---|---|---|---|
| 611 | DVD399H | AB063 | AB004 | EVQLVESGGGLVQPGGSLRLSCAASGFTFSIYSMN WVRQAPGKGLEWVSYISSSSSTIYYADSVKGRFTI SRDNAKNSLYLQMNSLRDEDTAVYYCARDRGDFDA FDIWGQGTMVTVSSASTKGPSVFPLAPEVQLVESG GGLVQPGGSLRLSCAASGFNIKDTYIHWVRQAPGK GLEWVARIYPTNGYTRYADSVKGRFTISADTSKNT AYLQMNSLRAEDTAVYYCSRWGGDGFYAMDYWGQG TLVTVSS |
| 612 | DVD399L | AB063 | AB004 | DIQMTQSPSSLSASVGDRVTITCQASQDITNYLNW YQQKPGKAPKLLIYDASNLETGVPSRFSGSGSGTD FTFTISSLQPEDIATYNCQQCENFPITFGQGTRLE IKRTVAAPSVFIFPPDIQMTQSPSSLSASVGDRVT ITCRASQDVNTAVAWYQQKPGKAPKLLIYSASFLY SGVPSRFSGSRSGTDFTLTISSLQPEDFATYYCQQ HYTTPPTFGQGTKVEIKR |
| 613 | DVD400H | AB004 | AB063 | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPSVFPLAPEVQLVES GGGLVQPGGSLRLSCAASGFTFSIYSMNWVRQAPG KGLEWVSYISSSSSTIYYADSVKGRFTISRDNAKN SLYLQMNSLRDEDTAVYYCARDRGDFDAFDIWGQG TMVTVSS |
| 614 | DVD400L | AB004 | AB063 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPSVFIFPPDIQMTQSPSSLSASVGDRVT ITCQASQDITNYLNWYQQKPGKAPKLLIYDASNLE TGVPSRFSGSGSGTDFTFTISSLQPEDIATYNCQQ CENFPITFGQGTRLEIKR |

Example 2.130

Generation of HER2 (Seq. 1) and ErbB3 (Seq. 2) DVD-Igs with Linker Set 2

TABLE 163

| DVD SEQ ID NO | Variable Domain Name | Outer Variable Domain Name | Inner Variable Domain Name | Sequence 123456789012345678901234567890123456789012345 |
|---|---|---|---|---|
| 615 | DVD403H | AB063 | AB004 | EVQLVESGGGLVQPGGSLRLSCAASGFTFSIYSMN WVRQAPGKGLEWVSYISSSSSTIYYADSVKGRFTI SRDNAKNSLYLQMNSLRDEDTAVYYCARDRGDFDA FDIWGQGTMVTVSSASTKGPSVFPLAPEVQLVESG GGLVQPGGSLRLSCAASGFNIKDTYIHWVRQAPGK GLEWVARIYPTNGYTRYADSVKGRFTISADTSKNT AYLQMNSLRAEDTAVYYCSRWGGDGFYAMDYWGQG TLVTVSS |
| 616 | DVD403L | AB063 | AB004 | DIQMTQSPSSLSASVGDRVTITCQASQDITNYLNW YQQKPGKAPKLLIYDASNLETGVPSRFSGSGSGTD FTFTISSLQPEDIATYNCQQCENFPITFGQGTRLE IKRTVAAPDIQMTQSRSSLSASVGDRVTITCRASQ DVNTAVAWYQQKPGKAPKLLIYSASFLYSGVPSRF SGSRSGTDFTLTISSLQPEDFATYYCQQHYTTPPT FGQGTKVEIKR |

TABLE 163-continued

| DVD SEQ ID NO | Outer Variable Domain Name | Inner Variable Domain Name | Sequence 12345678901234567890123456789012345 |
|---|---|---|---|
| 617 DVD404H | AB004 | AB063 | EVQLVESGGGLVQRGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPSVFPLAPEVQLVES GGGLVQPGGSLRLSCAASGFTFSIYSMNWVRQAPG KGLEWVSYISSSSSTIYYADSVKGRFTISRDNAKN SLYLQMNSLRDEDTAVYYCARDRGDFDAFDIWGQG TMVTVSS |
| 618 DVD404L | AB004 | AB063 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPDIQMTQSPSSLSASVGDRVTITCQASQ DITNYLNWYQQKPGKAPKLLIYDASNLETGVPSRF SGSGSGTDFTFTISSLQPEDIATYNCQQCENFPIT FGQGTRLEIKR |

Example 2.131

Generation of HER2 (Seq. 1) and ErbB3 (Seq. 2) DVD-Igs with Linker Set 3

TABLE 164

| DVD SEQ ID NO | Outer Variable Domain Name | Inner Variable Domain Name | Sequence 12345678901234567890123456789012345 |
|---|---|---|---|
| 619 DVD407H | AB063 | AB004 | EVQLVESGGGLVQPGGSLRLSCAASGFTFSIYSMN WVRQAPGKGLEWVSYISSSSSTIYYADSVKGRFTI SRDNAKNSLYLQMNSLRDEDTAVYYCARDRGDFDA FDIWGQGTMVTVSSASTKGPEVQLVESGGGLVQPG GSLRLSCAASGFNIKDTYIHWVRQAPGKGLEWVAR IYPTNGYTRYADSVKGRFTISADTSKNTAYLQMNS LRAEDTAVYYCSRWGGDGFYAMDYWGQGTLVTVSS |
| 620 DVD407L | AB063 | AB004 | DIQMTQSPSSLSASVGDRVTITCQASQDITNYLNW YQQKPGKAPKLLIYDASNLETGVPSRFSGSGSGTD FIFTISSLQPEDIATYNCQQCENFPITFGQGTRLE IKRTVAAPSVFIFPPDIQMTQSPSSLSASVGDRVT ITCRASQDVNTAVAWYQQKPGKAPKLLIYSASFLY SGVPSRFSGSRSGTDFTLTISSLQPEDFATYYCQQ HYTTPPTFGQGTKVEIKR |
| 621 DVD408H | AB004 | AB063 | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPEVQLVESGGGLVQP GGSLRLSCAASGFTFSIYSMNWVRQAPGKGLEWVS YISSSSSTIYYADSVKGRFTISRDNAKNSLYLQMN SLRDEDTAVYYCARDRGDFDAFDIWGQGTMVTVSS |
| 622 DVD408L | AB004 | AB063 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPSVFIFPPDIQMTQSPSSLSASVGDRVT ITCQASQDITNYLNWYQQKPGKAPKLLIYDASNLE TGVPSRFSGSGSGTDFTFTISSLQPEDIATYNCQQ CENFPITFGQGTRLEIKR |

Example 2.132

Generation of HER2 (Seq. 1) and ErbB3 (Seq. 2)
DVD-Igs with Linker Set 4

TABLE 165

| DVD SEQ ID NO | Outer Variable Domain Name | Inner Variable Domain Name | Sequence 123456789012345678901234567890123345 |
|---|---|---|---|
| 623 | DVD685H AB063 | AB004 | EVQLVESGGGLVQPGGSLRLSCAASGFTFSIYSMN WVRQAPGKGLEWVSYISSSSSTIYYADSVKGRFTI SRDNAKNSLYLQMNSLRDEDTAVYYCARDRGDFDA FDIWGQGTMVTVSSASTKGPEVQLVESGGGLVQPG GSLRLSCAASGFNIKDTYIHWVRQAPGKGLEWVAR IYPTNGYTRYADSVKGRFTISADTSKNTAYLQMNS LRAEDTAVYYCSRWGGDGFYAMDYWGQGTLVTVSS |
| 624 | DVD685L AB063 | AB004 | DIQMTQSRSSLSASVGDRVTITCQASQDITNYLNW YQQKPGKAPKLLIYDASNLETGVPSRFSGSGSGTD FTFTISSLQPEDIATYNCQQCENFPITFGQGTRLE IKRTVAAPDIQMTQSPSSLSASVGDRVTITCRASQ DVNTAVAWYQQKPGKAPKLLIYSASFLYSGVPSRF SGSRSGTDFTLTISSLQPEDFATYYCQQHYTTPPT FGQGTKVEIKR |
| 625 | DVD686H AB004 | AB063 | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPEVQLVESGGGLVQP GGSLRLSCAASGFTFSIYSMNWVRQAPGKGLEWVS YISSSSSTIYYADSVKGRFTISRDNAKNSLYLQMN SLRDEDTAVYYCARDRGDFDAFDIWGQGTMVTVSS |
| 626 | DVD686L AB004 | AB063 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPDIQMTQSPSSLSASVGDRVTITCQASQ DITNYLNWYQQKPGKAPKLLIYDASNLETGVPSRF SGSGSGTDFTFTISSLQPEDIATYNCQQCENFPIT FGQGTRLEIKR |

Example 2.133

Generation of EGFR (Seq. 2) and ErbB3 (Seq. 3)
DVD-Igs with Linker Set 1

TABLE 166

| DVD SEQ ID NO | Outer Variable Domain Name | Inner Variable Domain Name | Sequence 123456789012345678901234567890123345 |
|---|---|---|---|
| 627 | DVD409H AB067 | AB033 | EVQLLESGGGLVQPGGSLRLSCAASGFTFSHYVMA WVRQAPGKGLEWVSSISSSGGWTLYADSVKGRFTI SRDNSKNTLYLQMNSLRAEDTAVYYCTRGLKMATI FDYWGQGTLVTVSSASTKGPQVQLKQSGPGLVQPS QSLSITCTVSGFSLTNYGVHWVRQSPGKGLEWLGV IWSGGNTDYNTPFTSRLSINKDNSKSQVFFKMNSL QSNDTAIYYCARALTYYDYEFAYWGQGTLVTVSA |
| 628 | DVD409L AB067 | AB033 | QSALTQPASVSGSPGQSITISCTGTSSDVGSYNVV SWYQQHPGKAPKLIIYEVSQRPSGVSNRFSGSKSG NTASLTISGLQTEDEADYYCCSYAGSSIFVIFGGG TKVTVLGQPKAAPDILLTQSPVILSVSPGERVSFS CRASQSIGTNIHWYQQRTNGSPRLLIKYASESISG IPSRFSGSGSGTDFTLSINSVESEDIADYYCQQNN NWPTTFGAGTKLELKR |
| 629 | DVD410H AB033 | AB067 | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPEVQLLESGGGLVQPG |

TABLE 166-continued

| DVD SEQ ID NO | Outer Variable Domain Name | Inner Variable Domain Name | Sequence 12345678901234567890123456789012345 |
|---|---|---|---|
| | | | GSLRLSCAASGFTFSHYVMAWVRQAPGKGLEWVSS ISSSGGWTLYADSVKGRFTISRDNSKNTLYLQMNS LRAEDTAVYYCTRGLKMATIFDYWGQGTLVTVSS |
| 630 DVD410L | AB033 | AB067 | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPQSALTQPASVSGSPGQSITISCTGTSS DVGSYNVVSWYQQHPGKAPKLIIYEVSQRPSGVSN RFSGSKSGNTASLTISGLQTEDEADYYCCSYAGSS IFVIFGGGTKVTVLG |

Example 2.134

Generation of EGFR (Seq. 2) and ErbB3 (Seq. 3) DVD-Igs with Linker Set 2

TABLE 167

| DVD SEQ ID NO | Outer Variable Domain Name | Inner Variable Domain Name | Sequence 12345678901234567890123456789012345 |
|---|---|---|---|
| 631 DVD413H | AB067 | AB033 | EVQLLESGGGLVQPGGSLRLSCAASGFTFSHYVMA WVRQAPGKGLEWVSSISSSGGWTLYADSVKGRFTI SRDNSKNTLYLQMNSLRAEDTAVYYCTRGLKMATI FDYWGQGTLVTVSSASTKGPSVFPLAPQVQLKQSG PGLVQPSQSLSITCTVSGFSLTNYGVHWVRQSPGK GLEWLGVIWSGGNTDYNTPFTSRLSINKDNSKSQV FFKMNSLQSNDTAIYYCARALTYYDYEFAYWGQGT LVTVSA |
| 632 DVD413L | AB067 | AB033 | QSALTQPASVSGSPGQSITISCTGTSSDVGSYNVV SWYQQHPGKAPKLIIYEVSQRPSGVSNRFSGSKSG NTASLTISGLQTEDEADYYCCSYAGSSIFVIFGGG TKVTVLGQPKAAPSVTLFPPDILLTQSPVILSVSP GERVSFSCRASQSIGTNIHWYQQRTNGSPRLLIKY ASESISGIPSRFSGSGSGTDFTLSINSVESEDIAD YYCQQNNNWPTTFGAGTKLELKR |
| 633 DVD414H | AB033 | AB067 | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPSVFPLAPEVQLLESG GGLVQPGGSLRLSCAASGFTFSHYVMAWVRQAPGK GLEWVSSISSSGGWTLYADSVKGRFTISRDNSKNT LYLQMNSLRAEDTAVYYCTRGLKMATIFDYWGQGT LVTVSS |
| 634 DVD414L | AB033 | AB067 | DILLTQSPVILSVSPGERVSFSCRASQSIGTNIHW YQQRTNGSPRLLIKYASESISGIPSRFSGSGSGTD FILSINSVESEDIADYYCQQNNNWPTTFGAGTKLE LKRTVAAPSVFIFPPQSALTQPASVSGSPGQSITI SCTGTSSDVGSYNVVSWYQQHPGKAPKLIIYEVSQ RPSGVSNRFSGSKSGNIASLTISGLQTEDEADYYC CSYAGSSIFVIFGGGTKVTVLG |

Example 2.135

Generation of EGFR (Seq. 2) and ErbB3 (Seq. 3) DVD-Igs with Linker Set 3

TABLE 168

| DVD SEQ ID NO | DVD Variable Domain Name | Outer Variable Domain Name | Inner Variable Domain Name | Sequence 123456789012345678901234567890123456789012345 |
|---|---|---|---|---|
| 635 | DVD417H | AB067 | AB033 | EVQLLESGGGLVQPGGSLRLSCAASGFTFSHYVMA WVRQAPGKGLEWVSSISSSGGWTLYADSVKGRFTI SRDNSKNTLYLQMNSLRAEDTAVYYCTRGLKMATI FDYWGQGTLVTVSSASTKGPSVFPLAPQVQLKQSG PGLVQPSQSLSITCTVSGFSLTNYGVHWVRQPRGK GLEWLGVIWSGGNTDYNTPFTSRLSINKDNSKSQV FFKMNSLQSNDTAIYYCARALTYYDYEFAYWGQGT LVTVSA |
| 636 | DVD417L | AB067 | AB033 | QSALTQPASVSGSPGQSITISCTGTSSDVGSYNVV SWYQQHPGKAPKLIIYEVSQRPSGVSNRFSGSKSG NTASLTISGLQTEDEADYYCCSYAGSSIFVIFGGG TKVTVLGQPKAAPDILLTQSPVILSVSPGERVSFS CRASQSIGTNIHWYQQRTNGSPRLLIKYASESISG IPSRFSGSGSGTDFTLSINSVESEDIADYYCQQNN NWPTTFGAGTKLELKR |
| 637 | DVD418H | AB033 | AB067 | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPSVFPLAPEVQLLESG GGLVQPGGSLRLSCAASGFTFSHYVMAWVRQAPG KGLEWVSSISSSGGWTLYADSVKGRFTISRDNSKNT LYLQMNSLRAEDTAVYYCTRGLKMATIFDYWGQGT LVTVSS |
| 638 | DVD418L | AB033 | AB067 | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPQSALTQPASVSGSPGQSITISCIGISS DVGSYNVVSWYQQHPGKAPKLIIYEVSQRPSGVSN RFSGSKSGNTASLTISGLQTEDEADYYCCSYAGSS IFVIFGGGTKVTVLG |

Example 2.136

Generation of EGFR (Seq. 2) and ErbB3 (Seq. 3) DVD-Igs with Linker Set 4

TABLE 169

| DVD SEQ ID NO | DVD Variable Domain Name | Outer Variable Domain Name | Inner Variable Domain Name | Sequence 123456789012345678901234567890123456789012345 |
|---|---|---|---|---|
| 639 | DVD421H | AB067 | AB033 | EVQLLESGGGLVQPGGSLRLSCAASGETESHYVMA WVRQAPGKGLEWVSSISSSGGWTLYADSVKGRETI SRDNSKNTLYLQMNSLRAEDTAVYYCTRGLKMATI FDYWGQGTLVTVSSASTKGPQVQLKQSGPGLVQPS QSLSITCTVSGFSLTNYGVHWVRQSPGKGLEWLGV IWSGGNTDYNTPFTSRLSINKDNSKSQVFFKMNSL QSNDTAIYYCARALTYYDYEEAYWGQGTLVTVSA |
| 640 | DVD421L | AB067 | AB033 | QSALTQPASVSGSPGQSITISCTGTSSDVGSYNVV SWYQQHPGKAPKLIIYEVSQRPSGVSNRFSGSKSG NTASLTISGLQTEDEADYYCCSYAGSSIFVIFGGG TKVTVLGQPKAAPSVTLFPPDILLTQSPVILSVSP GERVSFSCRASQSIGTNIHWYQQRTNGSPRLLIKY ASESISGIPSRFSGSGSGTDFTLSINSVESEDIAD YYCQQNNNWPTTFGAGTKLELKR |

TABLE 169-continued

| DVD SEQ ID NO | Outer Variable Domain Name | Inner Variable Domain Name | Sequence 123456789012345678901234567890123456789012345 |
|---|---|---|---|
| 641 DVD422H | AB033 | AB067 | QVQLKQSGPGLVQPSQSLSITCTVSGFSLTNYGVH WVRQSPGKGLEWLGVIWSGGNTDYNTPFTSRLSIN KDNSKSQVFFKMNSLQSNDTAIYYCARALTYYDYE FAYWGQGTLVTVSAASTKGPEVQLLESGGGLVQPG GSLRLSCAASGFTFSHYVMAWVRQAPGKGLEWVSS ISSSGGWTLYADSVKGRFTISRDNSKNTLYLQMNS LRAEDTAVYYCTRGLKMATIFDYWGQGTLVTVSS |
| 642 DVD422L | AB033 | AB067 | DILLTQSPVILSVSPGERVSFSCRASQSIGTNIHW YQQRTNGSPRLLIKYASESISGIPSRFSGSGSGTD FTLSINSVESEDIADYYCQQNNNWPTTFGAGTKLE LKRTVAAPSVFIFPPQSALTQPASVSGSPGQSITI SCTGTSSDVGSYNVVSWYQQHPGKAPKLIIYEVSQ RPSGVSNRFSGSKSGNTASLTISGLQTEDEADYYC CSYAGSSIFVIFGGGTKVTVLG |

Example 2.137

Generation of HER2 (Seq. 1) and ErbB3 (Seq. 3) DVD-Igs with Linker Set 1

TABLE 170

| DVD SEQ ID NO | Outer Variable Domain Name | Inner Variable Domain Name | Sequence 123456789012345678901234567890123456789012345 |
|---|---|---|---|
| 643 DVD411H | AB067 | AB004 | EVQLLESGGGLVQPGGSLRLSCAASGFTFSHYVMA WVRQAPGKGLEWVSSISSSGGWTLYADSVKGRFTI SRDNSKNTLYLQMNSLRAEDTAVYYCTRGLKMATI FDYWGQGTLVTVSSASTKGPEVQLVESGGGLVQPG GSLRLSCAASGFNIKDTYIHWVRQAPGKGLEWVAR IYPTNGYTRYADSVKGRFTISADTSKNTAYLQMNS LRAEDTAVYYCSRWGGDGFYAMDYWGQGTLVTVSS |
| 644 DVD411L | AB067 | AB004 | QSALTQPASVSGSPGQSITISCTGTSSDVGSYNVV SWYQQHPGKAPKLIIYEVSQRPSGVSNRESGSKSG NTASLTISGLQTEDEADYYCCSYAGSSIFVIFGGG TKVTVLGQPKAAPDIQMTQSPSSLSASVGDRVTIT CRASQDVNTAVAWYQQKPGKAPKLLIYSASFLYSG VRSRFSGSRSGTDFTLTISSLQPEDFATYYCQQHY TTPPTFGQGTKVEIKR |
| 645 DVD412H | AB004 | AB067 | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPEVQLLESGGGLVQP GGSLRLSCAASGFTFSHYVMAWVRQAPGKGLEWVS SISSSGGWTLYADSVKGRFTISRDNSKNTLYLQMN SLRAEDTAVYYCTRGLKMATIFDYWGQGTLVTVSS |
| 646 DVD412L | AB004 | AB067 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPQSALTQPASVSGSPGQSITISCTGTSS DVGSYNVVSWYQQHPGKAPKLIIYEVSQRPSGVSN RFSGSKSGNTASLTISGLQTEDEADYYCCSYAGSS IFVIFGGGTKVTVLG |

Example 2.138

Generation of HER2 (Seq. 1) and ErbB3 (Seq. 3)
DVD-Igs with Linker Set 2

TABLE 171

| DVD SEQ ID NO | Variable Domain Name | Outer Variable Domain Name | Inner Variable Domain Name | Sequence 12345678901234567890123456789012345 |
|---|---|---|---|---|
| 647 | DVD415H | AB067 | AB004 | EVQLLESGGGLVQPGGSLRLSCAASGFTFSHYVMA WVRQAPGKGLEWVSSISSSGGWTLYADSVKGRFTI SRDNSKNTLYLQMNSLRAEDTAVYYCTRGLKMATI FDYWGQGTLVTVSSASTKGPSVFPLAPEVQLVESG GGLVQPGGSLRLSCAASGFNIKDTYIHWVRQAPGK GLEWVARIYPTNGYTRYADSVKGRFTISADTSKNT AYLQMNSLRAEDTAVYYCSRWGGDGFYAMDYWGQG TLVTVSS |
| 648 | DVD415L | AB067 | AB004 | QSALTQPASVSGSPGQSITISCTGTSSDVGSYNVV SWYQQHPGKARKLIIYEVSQRRSGVSNRFSGSKSG NTASLTISGLQTEDEADYYCCSYAGSSIFVIFGGG TKVTVLGQPKAAPSVTLFPPDIQMTQSPSSLSASV GDRVTITCRASQDVNTAVAWYQQKPGKAPKLLIYS ASFLYSGVPSRFSGSRSGTDFTLTISSLQPEDFAT YYCQQHYTTPPTFGQGTKVEIKR |
| 649 | DVD416H | AB004 | AB067 | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPSVFPLAPEVQLLES GGGLVQPGGSLRLSCAASGFTFSHYVMAWVRQAPG KGLEWVSSISSSGGWTLYADSVKGRFTISRDNSKN TLYLQMNSLRAEDTAVYYCTRGLKMATIFDYWGQG TLVTVSS |
| 650 | DVD416L | AB004 | AB067 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPSVFIFPPQSALTQPASVSGSPGQSITI SCTGTSSDVGSYNVVSWYQQHPGKAPKLIIYEVSQ RPSGVSNRFSGSKSGNTASLTISGLQTEDEADYYC CSYAGSSIFVIFGGGTKVTVLG |

Example 2.139

Generation of HER2 (Seq. 1) and ErbB3 (Seq. 3)
DVD-Igs with Linker Set 3

TABLE 172

| DVD SEQ ID NO | Variable Domain Name | Outer Variable Domain Name | Inner Variable Domain Name | Sequence 12345678901234567890123456789012345 |
|---|---|---|---|---|
| 651 | DVD419H | AB067 | AB004 | EVQLLESGGGLVQPGGSLRLSCAASGFTFSHYVMA WVRQAPGKGLEWVSSISSSGGWTLYADSVKGRFTI SRDNSKNTLYLQMNSLRAEDTAVYYCTRGLKMATI FDYWGQGTLVTVSSASTKGPSVFPLAPEVQLVESG GGLVQPGGSLRLSCAASGFNIKDTYIHWVRQAPGK GLEWVARIYPTNGYTRYADSVKGRFTISADTSKNT AYLQMNSLRAEDTAVYYCSRWGGDGFYAMDYWGQG TLVTVSS |
| 652 | DVD419L | AB067 | AB004 | QSALTQPASVSGSPGQSITISCTGTSSDVGSYNVV SWYQQHPGKAPKLIIYEVSQRPSGVSNRFSGSKSG NTASLTISGLQTEDEADYYCCSYAGSSIFVIFGGG TKVTVLGQPKAAPDIQMTQSPSSLSASVGDRVTIT CRASQDVNTAVAWYQQKPGKAPKLLIYSASFLYSG VRSRFSGSRSGTDFTLTISSLQPEDFATYYCQQHY TTPPTFGQGTKVEIKR |

TABLE 172-continued

| DVD SEQ ID NO | Outer Variable Domain Name | Inner Variable Domain Name | Sequence 123456789012345678901234567890123456 |
|---|---|---|---|
| 653 DVD420H | AB004 | AB067 | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPSVFPLAPEVQLLES GGGLVQPGGSLRLSCAASGFTFSHYVMAWVRQAPG KGLEWVSSISSSGGWTLYADSVKGRFTISRDNSKN TLYLQMNSLRAEDTAVYYCTRGLKMATIFDYWGQG TLVTVSS |
| 654 DVD420L | AB004 | AB067 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPQSALTQPASVSGSPGQSITISCTGTSS DVGSYNVVSWYQQHPGKAPKLIIYEVSQRPSGVSN RFSGSKSGNTASLTISGLQTEDEADYYCCSYAGSS IFVIFGGGTKVTVLG |

Example 2.140

Generation of HER2 (Seq. 1) and ErbB3 (Seq. 3) DVD-Igs with Linker Set 4

TABLE 173

| DVD SEQ ID NO | Outer Variable Domain Name | Inner Variable Domain Name | Sequence 123456789012345678901234567890123456 |
|---|---|---|---|
| 655 DVD423H | AB067 | AB004 | EVQLLESGGGLVQPGGSLRLSCAASGFTFSHYVMA WVRQAPGKGLEWVSSISSSGGWTLYADSVKGRFTI SRDNSKNTLYLQMNSLRAEDTAVYYCTRGLKMATI FDYWGQGTLVTVSSASTKGPEVQLVESGGGLVQPG GSLRLSCAASGENIKDTYIHWVRQAPGKGLEWVAR IYPTNGYTRYADSVKGRFTISADTSKNTAYLQMNS LRAEDTAVYYCSRWGGDGFYAMDYWGQGTLVTVSS |
| 656 DVD423L | AB067 | AB004 | QSALTQPASVSGSPGQSITISCTGTSSDVGSYNVV SWYQQHPGKAPKLIIYEVSQRPSGVSNRFSGSKSG NTASLTISGLQTEDEADYYCCSYAGSSIFVIFGGG TKVTVLGQPKAAPSVTLFPPDIQMTQSRSSLSASV GDRVTITCRASQDVNTAVAWYQQKPGKAPKLLIYS ASFLYSGVRSRFSGSRSGTDFTLTISSLQPEDFAT YYCQQHYTTPPTFGQGTKVEIKR |
| 657 DVD424H | AB004 | AB067 | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPEVQLLESGGGLVQP GGSLRLSCAASGFTFSHYVMAWVRQAPGKGLEWVS SISSSGGWTLYADSVKGRFTISRDNSKNTLYLQMN SLRAEDTAVYYCTRGLKMATIFDYWGQGTLVTVSS |
| 658 DVD424L | AB004 | AB067 | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPSVFIFPPQSALTQPASVSGSPGQSITI SCTGTSSDVGSYNVVSWYQQHPGKAPKLIIYEVSQ RPSGVSNRFSGSKSGNTASLTISGLQTEDEADYYC CSYAGSSIFVIFGGGTKVTVLG |

Example 2.141

Generation of VEGF (Seq. 1) and PLGF (Seq. 2)
DVD-Igs with Linker Set 1

TABLE 174

| DVD SEQ ID NO | DVD Variable Domain Name | Outer Variable Domain Name | Inner Variable Domain Name | Sequence 12345678901234567890123456789012345 |
|---|---|---|---|---|
| 659 | DVD541H | AB074VH | AB014VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPEVQLVESGGGLVQPGGSL RLSCAASGYTFTNYGMNWVRQAPGKGLEWVGWINT YTGEPTYAADFKRRFTFSLDTSKSTAYLQMNSLRA EDTAVYYCAKYPHYYGSSHWYFDVWGQGTLVTVSS |
| 660 | DVD541L | AB074VL | AB014VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |
| 661 | DVD542H | AB014VH | AB074VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLKQSGPGL VQPSQSLSITCTVSGFSLTTYGIHWVRQSPGKGLE WLGVMWSGGDTDYDAAFISRLSISKDNSKSQVFFK MNSLQANDTGIYYCARYRFYGMDYWGQGTSVTVSS |
| 662 | DVD542L | AB014VL | AB074VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPAIQMTQSSSSFSVSLGDRVTITCKASE DIYNRFAWYQQKPGNAPRLLISGAASLEAGVPSRF SGSGSGQDYTLSITSLQTEDVATYYCQQYWSTPWT FGGGTKLEIKR |

Example 2.142

Generation of VEGF (Seq. 1) and PLGF (Seq. 2)
DVD-Igs with Linker Set 2

TABLE 175

| DVD SEQ ID NO | DVD Variable Domain Name | Outer Variable Domain Name | Inner Variable Domain Name | Sequence 12345678901234567890123456789012345 |
|---|---|---|---|---|
| 663 | DVD549H | AB074VH | AB014VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPSVFPLAPEVQLVESGGGL VQPGGSLRLSCAASGYTFTNYGMNWVRQAPGKGLE WVGWINTYTGEPTYAADFKRRFTFSLDTSKSTAYL QMNSLRAEDTAVYYCAKYPHYYGSSHWYFDVWGQG TLVTVSS |
| 664 | DVD549L | AB074VL | AB014VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPSVFIFPPDIQMTQSPSSLSASVGDRVT ITCSASQDISNYLNWYQQKPGKAPKVLIYFTSSLH SGVPSRFSGSGSGTDFTLTISSLQPEDFATYYCQQ YSTVPWTFGQGTKVEIKR |
| 665 | DVD550H | AB014VH | AB074VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS |

TABLE 175-continued

| DVD SEQ ID NO | DVD Variable Domain Name | Outer Variable Domain Name | Inner Variable Domain Name | Sequence 123456789012345678901234567890123456789012345 |
|---|---|---|---|---|
| | | | | SHWYFDVWGQGTLVTVSSASTKGPSVFPLAPQVQL KQSGPGLVQPSQSLSITCTVSGFSLTTYGIHWVRQ SPGKGLEWLGVMWSGGDTDYDAAFISRLSISKDNS KSQVFFKMNSLQANDTGIYYCARYRFYGMDYWGQG TSVTVSS |
| 666 | DVD550L | AB014VL | AB074VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPAIQMTQSSSSFSVSLGDRVT ITCKASEDIYNRFAWYQQKPGNAPRLLISGAASLE AGVPSRFSGSGSGQDYTLSITSLQTEDVATYYCQQ YWSTPWTFGGGTKLEIKR |

Example 2.143

Generation of VEGF (Seq. 1) and PLGF (Seq. 2) DVD-Igs with Linker Set 3

TABLE 176

| DVD SEQ ID NO | DVD Variable Domain Name | Outer Variable Domain Name | Inner Variable Domain Name | Sequence 123456789012345678901234567890123456789012345 |
|---|---|---|---|---|
| 667 | DVD557H | AB074VH | AB014VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPSVFPLAPEVQLVESGGGL VQPGGSLRLSCAASGYTFTNYGMNWVHQAPGKGLE WVGWINTYTGEPTYAADFKRRFTFSLDTSKSTAYL QMNSLRAEDTAVYYCAKYPHYYGSSHWYFDVWGQG TLVTVSS |
| 668 | DVD557L | AB074VL | AB014VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |
| 669 | DVD558H | AB014VH | AB074VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPQVQL KQSGPGLVQPSQSLSITCTVSGFSLTTYGIHWVRQ SPGKGLEWLGVMWSGGDTDYDAAFISRLSISKDNS KSQVFFKMNSLQANDTGIYYCARYRFYGMDYWGQG TSVTVSS |
| 670 | DVD558L | AB014VL | AB074VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPAIQMTQSSSSFSVSLGDRVTITCKASE DIYNRFAWYQQKPGNAPRLLISGAASLEAGVPSRF SGSGSGQDYTLSITSLQTEDVATYYCQQYWSTPWT FGGGTKLEIKR |

Example 2.144

Generation of VEGF (Seq. 1) and PLGF (Seq. 2)
DVD-Igs with Linker Set 4

TABLE 177

| DVD SEQ ID NO | Outer Variable Domain Name | Inner Variable Domain Name | Sequence 123456789012345678901234567890123456789012345 |
|---|---|---|---|
| 671 | DVD565H AB074VH | AB014VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPEVQLVESGGGLVQPGGSL RLSCAASGYTFTNYGMNWVRQAPGKGLEWVGWINT YTGEPTYAADFKRRFTFSLDTSKSTAYLQMNSLRA EDTAVYYCAKYPHYYGSSHWYFDVWGQGTLVTVSS |
| 672 | DVD565L AB074VL | AB014VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPSVFIFPPDIQMTQSPSSLSASVGDRVT ITCSASQDISNYLNWYQQKPGKAPKVLIYFTSSLH SGVPSRFSGSGSGTDFTLTISSLQPEDFATYYCQQ YSTVPWTFGQGTKVEIKR |
| 673 | DVD566H AB014VH | AB074VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPQVQLKQSGPGL VQPSQSLSITCTVSGFSLTTYGIHWVRQSPGKGLE WLGVMWSGGDTDYDAAFISRLSISKDNSKSQVFFK MNSLQANDTGIYYCARYRFYGMDYWGQGTSVTVSS |
| 674 | DVD566L AB014VL | AB074VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPAIQMTQSSSSFSVSLGDRVT ITCKASEDIYNRFAWYQQKPGNAPRLLISGAASLE AGVPSRFSGSGSGQDYTLSITSLQTEDVATYYCQQ YWSTPWTFGGGTKLEIKR |

Example 2.145

Generation of VEGF (Seq. 2) and PLGF (Seq. 2)
DVD-Igs with Linker Set 1

TABLE 178

| DVD SEQ ID NO | Outer Variable Domain Name | Inner Variable Domain Name | Sequence 123456789012345678901234567890123456789012345 |
|---|---|---|---|
| 675 | DVD543H AB074VH | AB070VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPEVQLVESGGGLVQPGGSL RLSCAASGFTISDYWIHWVRQAPGKGLEWVAGITP AGGYTYYADSVKGRFTISADTSKNTAYLQMNSLRA EDTAVYYCARFVFFLPYAMDYWGQGTLVTVSS |
| 676 | DVD543L AB074VL | AB070VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPDIQMTQSPSSLSASVGDRVTITCRASQ DVSTAVAWYQQKPGKAPKLLIYSASFLYSGVPSRF SGSGSGTDFTLTISSLQPEDFATYYCQQSYTTPPT FGQGTKVEIKR |
| 677 | DVD544H AB070VH | AB074VH | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPQVQLKQSGPGLVQP |

TABLE 178-continued

| DVD SEQ ID NO | Outer Variable Domain Name | Inner Variable Domain Name | Sequence 12345678901234567890123456789012345 |
|---|---|---|---|
| | | | SQSLSITCTVSGFSLTTYGIHWVRQSPGKGLEWLG VMWSGGDTDYDAAFISRLSISKDNSKSQVFFKMNS LQANDTGIYYCARYRFYGMDYWGQGTSVTVSS |
| 678 DVD544L | AB070VL | AB074VL | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPAIQMTQSSSSFSVSLGDRVTITCKASE DIYNRFAWYQQKPGNAPRLLISGAASLEAGVPSRF SGSGSGQDYTLSITSLQTEDVATYYCQQYWSTPWT FGGGTKLEIKR |

Example 2.146

Generation of VEGF (Seq. 2) and PLGF (Seq. 2) DVD-Igs with Linker Set 2

TABLE 179

| DVD SEQ ID NO | Outer Variable Domain Name | Inner Variable Domain Name | Sequence 12345678901234567890123456789012345 |
|---|---|---|---|
| 679 DVD551H | AB074VH | AB070VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPSVFPLAPEVQLVESGGGL VQPGGSLRLSCAASGFTISDYWIHWVHQAPGKGLE WVAGITPAGGYTYYADSVKGRFTISADTSKNTAYL QMNSLRAEDTAVYYCARFVFFLPYAMDYWGQGTLV TVSS |
| 680 DVD551L | AB074VL | AB070VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPSVFIFPPDIQMTQSPSSLSASVGDRVT ITCRASQDVSTAVAWYQQKPGKAPKLLIYSASFLY SGVPSRFSGSGSGTDFTLTISSLQPEDFATYYCQQ SYTTPPTFGQGTKVEIKR |
| 681 DVD552H | AB070VH | AB074VH | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPQVQLKQS GPGLVQPSQSLSITCTVSGFSLTTYGIHWVRQSPG KGLEWLGVMWSGGDTDYDAAFISRLSISKDNSKSQ VFFKMNSLQANDTGIYYCARYRFYGMDYWGQGTSV TVSS |
| 682 DVD552L | AB070VL | AB074VL | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPSVFIFPPAIQMTQSSSSFSVSLGDRVT ITCKASEDIYNRFAWYQQKPGNAPRLLISGAASLE AGVPSRFSGSGSGQDYTLSITSLQTEDVATYYCQQ YWSTPWTFGGGTKLEIKR |

Example 2.147

Generation of VEGF (Seq. 2) and PLGF (Seq. 2) DVD-Igs with Linker Set 3

TABLE 180

| DVD SEQ ID NO | DVD Variable Domain Name | Outer Variable Domain Name | Inner Variable Domain Name | Sequence |
|---|---|---|---|---|
| 683 | DVD559H | AB074VH | AB070VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPSVFPLAPEVQLVESGGGL VQPGGSLRLSCAASGFTISDYWIHWVRQAPGKGLE WVAGITPAGGYTYYADSVKGRFTISADTSKNTAYL QMNSLRAEDTAVYYCARFVFFLPYAMDYWGQGTLV TVSS |
| 684 | DVD559L | AB074VL | AB070VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPDIQMTQSPSSLSASVGDRVTITCRASQ DVSTAVAWYQQKPGKAPKLLIYSASFLYSGVPSRF SGSGSGTDFTLTISSLQPEDFATYYCQQSYTTPPT FGQGTKVEIKR |
| 685 | DVD560H | AB070VH | AB074VH | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPQVQLKQS GPGLVQPSQSLSITCTVSGFSLTTYGIHWVRQSPG KGLEWLGVMWSGGDTDYDAAFISRLSISKDNSKSQ VFFKMNSLQANDTGIYYCARYRFYGMDYWGQGTSV TVSS |
| 686 | DVD560L | AB070VL | AB074VL | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPAIQMTQSSSSFSVSLGDRVTITCKASE DIYNRFAWYQQKPGNAPRLLISGAASLEAGVPSRF SGSGSGQDYTLSITSLQTEDVATYYCQQYWSTPWT FGGGTKLEIKR |

Example 2.148

Generation of VEGF (Seq. 2) and PLGF (Seq. 2) DVD-Igs with Linker Set 4

TABLE 181

| DVD SEQ ID NO | DVD Variable Domain Name | Outer Variable Domain Name | Inner Variable Domain Name | Sequence |
|---|---|---|---|---|
| 687 | DVD567H | AB074VH | AB070VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPEVQLVESGGGLVQPGGSL RLSCAASGFTISDYWIHWVRQAPGKGLEWVAGITP AGGYTYYADSVKGRFTISADTSKNTAYLQMNSLRA EDTAVYYCARFVFFLPYAMDYWGQGTLVTVSS |
| 688 | DVD567L | AB074VL | AB070VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPSVFIFPPDIQMTQSPSSLSASVGDRVT ITCRASQDVSTAVAWYQQKPGKAPKLLIYSASFLY SGVPSRFSGSGSGTDFTLTISSLQPEDFATYYCQQ SYTTPPTFGQGTKVEIKR |
| 689 | DVD568VH | AB070VH | AB074VH | EVQLVESGGGLVQPGGSLRLSCAASGFTISDYWIH WVRQAPGKGLEWVAGITPAGGYTYYADSVKGRFTI |

TABLE 181-continued

| DVD SEQ ID NO | Outer Variable Domain Name | Inner Variable Domain Name | Sequence 123456789012345678901234567890123456789012345 |
|---|---|---|---|
| | | | SADTSKNTAYLQMNSLRAEDTAVYYCARFVFFLPY<br>AMDYWGQGTLVTVSSASTKGPQVQLKQSGPGLVQP<br>SQSLSITCTVSGFSLTTYGIHWVRQSPGKGLEWLG<br>VMWSGGDTDYDAAFISRLSISKDNSKSQVFFKMNS<br>LQANDTGIYYCARYRFYGMDYWGQGTSVTVSS |
| 690 DVD568VL | AB070VL | AB074VL | DIQMTQSPSSLSASVGDRVTITCRASQDVSTAVAW<br>YQQKPGKAPKLLIYSASFLYSGVPSRFSGSGSGTD<br>FTLTISSLQPEDFATYYCQQSYTTPPTFGQGTKVE<br>IKRTVAAPSVFIFPPAIQMTQSSSSFSVSLGDRVT<br>ITCKASEDIYNRFAWYQQKPGNAPRLLISGAASLE<br>AGVPSRFSGSGSGQDYTLSITSLQTEDVATYYCQQ<br>YWSTPWTFGGGTKLEIKR |

Example 2.149

Generation of VEGF (Seq. 3) and PLGF (Seq. 2) DVD-Igs with Linker Set 1

TABLE 182

| DVD SEQ ID NO | Outer Variable Domain Name | Inner Variable Domain Name | Sequence 123456789012345678901234567890123456789012345 |
|---|---|---|---|
| 691 DVD545H | AB074VH | AB071VH | QVQLKQSGPGLVQPSQSLSITCTVSGFSLTTYGIH<br>WVRQSPGKGLEWLGVMWSGGDTDYDAAFISRLSIS<br>KDNSKSQVFFKMNSLQANDTGIYYCARYRFYGMDY<br>WGQGTSVTVSSASTKGPEVQLVESGGGLVQPGGSL<br>RLSCAASGFTINASWIHWVRQAPGKGLEWVGAIYP<br>YSGYTNYADSVKGRFTISADTSKNTAYLQMNSLRA<br>EDTAVYYCARWGHSTSPWAMDYWGQGTLVTVSS |
| 692 DVD545L | AB074VL | AB071VL | AIQMTQSSSSFSVSLGDRVTITCKASEDIYNRFAW<br>YQQKPGNAPRLLISGAASLEAGVPSRFSGSGSGQD<br>YTLSITSLQTEDVATYYCQQYWSTPWTFGGGTKLE<br>IKRTVAAPDIQMTQSRSSLSASVGDRVTITCRASQ<br>VIRRSLAWYQQKPGKAPKLLIYAASNLASGVPSRF<br>SGSGSGTDFTLTISSLQPEDFATYYCQQSNTSPLT<br>FGQGTKVEIKR |
| 693 DVD546H | AB071VH | AB074VH | EVQLVESGGGLVQPGGSLRLSCAASGFTINASWIH<br>WVRQAPGKGLEWVGAIYPYSGYTNYADSVKGRFTI<br>SADTSKNTAYLQMNSLRAEDTAVYYCARWGHSTSP<br>WAMDYWGQGTLVTVSSASTKGPQVQLKQSGPGLVQ<br>PSQSLSITCTVSGFSLTTYGIHWVRQSPGKGLEWL<br>GVMWSGGDTDYDAAFISRLSISKDNSKSQVFFKMN<br>SLQANDTGIYYCARYRFYGMDYWGQGTSVTVSS |
| 694 DVD546L | AB071VL | AB074VL | DIQMTQSPSSLSASVGDRVTITCRASQVIRRSLAW<br>YQQKPGKAPKLLIYAASNLASGVPSRFSGSGSGTD<br>FTLTISSLQPEDFATYYCQQSNTSPLTFGQGTKVE<br>IKRTVAAPAIQMTQSSSSFSVSLGDRVTITCKASE<br>DIYNRFAWYQQKRGNAPRLLISGAASLEAGVPSRF<br>SGSGSGQDYTLSITSLQTEDVATYYCQQYWSTPWT<br>FGGGTKLEIKR |

Example 2.150

Generation of VEGF (Seq. 3) and PLGF (Seq. 2)
DVD-Igs with Linker Set 2

TABLE 183

| DVD SEQ ID NO | Outer Variable Domain Name | Inner Variable Domain Name | Sequence 12345678901234567890123456789012345 |
|---|---|---|---|
| 695 | DVD553H AB074VH | AB071VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPSVFPLAPEVQLVESGGGL VQPGGSLRLSCAASGFTINASWIHWVRQAPGKGLE WVGAIYPYSGYTNYADSVKGRFTISADISKNTAYL QMNSLRAEDTAVYYCARWGHSTSPWAMDYWGQGTL VTVSS |
| 696 | DVD553L AB074VL | AB071VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPSVFIFPPDIQMTQSPSSLSASVGDRVT ITCRASQVIRRSLAWYQQKPGKAPKLLIYAASNLA SGVPSRFSGSGSGTDFTLTISSLQPEDFATYYCQQ SNTSPLTFGQGTKVEIKR |
| 697 | DVD554H AB071VH | AB074VH | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSSTKGPSVFPLAPQVQLKQ SGPGLVQPSQSLSITCTVSGFSLTTYGIHWVRQSP GKGLEWLGVMWSGGDTDYDAAFISRLSISKDNSKS QVFFKMNSLQANDTGIYYCARYRFYGMDYWGQTS VTVSS |
| 698 | DVD554L AB071VL | AB074VL | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPSVFIFPPAIQMTQSSSSFSVSLGDRVT ITCKASEDIYNRFAWYQQKPGNAPRLLISGAASLE AGVPSRFSGSGSGQDYTLSITSLQTEDVATYYCQQ YWSTPWTFGGGTKLEIKR |

Example 2.151

Generation of VEGF (Seq. 3) and PLGF (Seq. 2)
DVD-Igs with Linker Set 3

TABLE 184

| DVD SEQ ID NO | Outer Variable Domain Name | Inner Variable Domain Name | Sequence 12345678901234567890123456789012345 |
|---|---|---|---|
| 699 | DVD561H AB074VH | AB071VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPSVFPLAPEVQLVESGGGL VQPGGSLRLSCAASGFTINASWIHWVRQAPGKGLE WVGAIYPYSGYTNYADSVKGRFTISADISKNTAYL QMNSLRAEDTAVYYCARWGHSTSPWAMDYWGQGTL VTVSS |
| 700 | DVD561L AB074VL | AB071VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPDIQMTQSPSSLSASVGDRVTITCRASQ VIRRSLAWYQQKRGKAPKLLIYAASNLASGVPSRF SGSGSGTDE1LIISSLQPEDFATYYCQQSNTSPLT FGQGTKVEIKR |

TABLE 184-continued

| DVD SEQ ID NO | DVD Variable Domain Name | Outer Variable Domain Name | Inner Variable Domain Name | Sequence 123456789012345678901234567890123456 |
|---|---|---|---|---|
| 701 | DVD562H | AB071VH | AB074VH | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPSVFPLAPQVQLKQ SGPGLVQPSQSLSITCTVSGFSLTTYGIHWVRQSP GKGLEWLGVMWSGGDTDYDAAFISRLSISKDNSKS QVFFKMNSLQANDTGIYYCARYRFYGMDYWGQGTS VTVSS |
| 702 | DVD562L | AB071VL | AB074VL | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPAIQMTQSSSSFSVSLGDRVTITCKASE DIYNRFAWYQQKPGNAPRLLISGAASLEAGVPSRF SGSGSGQDYTLSITSLQTEDVATYYCQQYWSTPWT FGGGTKLEIKR |

Example 2.152

Generation of VEGF (Seq. 3) and PLGF (Seq. 2) DVD-Igs with Linker Set 4

TABLE 185

| DVD SEQ ID NO | DVD Variable Domain Name | Outer Variable Domain Name | Inner Variable Domain Name | Sequence 123456789012345678901234567890123456 |
|---|---|---|---|---|
| 703 | DVD569H | AB074VH | AB071VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPEVQLVESGGGLVQPGGSL RLSCAASGFTINASWIHWVRQAPGKGLEWVGAIYP YSGYTNYADSVKGRFTISADTSKNTAYLQMNSLRA EDTAVYYCARWGHSTSPWAMDYWGQGTLVTVSS |
| 704 | DVD569L | AB074VL | AB071VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPSVFIFPPDIQMTQSPSSLSASVGDRVT ITCRASQVIRRSLAWYQQKPGKAPKLLIYAASNLA SGVPSRFSGSGSGTDFTLTISSLQPEDFATYYCQQ SNTSPLTFGQGTKVEIKR |
| 705 | DVD570H | AB071VH | AB074VH | EVQLVESGGGLVQPGGSLRLSCAASGFTINASWIH WVRQAPGKGLEWVGAIYPYSGYTNYADSVKGRFTI SADISKNTAYLQMNSLRAEDTAVYYCARWGHSTSP WAMDYWGQGTLVTVSSASTKGPQVQLKQSGPGLVQ PSQSLSITCTVSGFSLTTYGIHWVRQSPGKGLEWL GVMWSGGDTDYDAAFISRLSISKDNSKSQVFFKMN SLQANDTGIYYCARYRFYGMDYWGQGTSVTVSS |
| 706 | DVD570L | AB071VL | AB074VL | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPSVFIFPPAIQMTQSSSSFSVSLGDRVT ITCKASEDIYNRFAWYQQKPGNAPRLLISGAASLE AGVPSRFSGSGSGQDYTLSITSLQTEDVATYYCQQ YWSTPWTFGGGTKLEIKR |

Example 2.153

Generation of HER2 (Seq. 1) and PLGF (Seq. 2)
DVD-Igs with Linker Set 1

TABLE 186

| DVD SEQ ID NO | Outer Variable Domain Name | Inner Variable Domain Name | Sequence 123456789012345678901234567890123456789012345 |
|---|---|---|---|
| 707 | DVD547H AB074VH | AB004VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPEVQLVESGGGLVQPGGSL RLSCAASGFNIKDTYIHWVRQAPGKGLEWVARIYP TNGYTRYADSVKGRFTISADTSKNTAYLQMNSLRA FDTAVYYCSRWGGDGFYAMDYWGQGTLVTVSS |
| 708 | DVD547L AB074VL | AB004VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPDIQMTQSPSSLSASVGDRVTITCRASQ DVNTAVAWYQQKPGKAPKLLIYSASFLYSGVPSRF SGSRSGTDFTLTISSLQPEDFATYYCQQHYTTPPT FGQGTKVEIKR |
| 709 | DVD548H AB004VH | AB074VH | EVQLVESGGGLVQRGGSLRLSCAASGFNIKDTYIH WVRQARGKGLEWVARIYRTNGYTRYADSVKGRFTI SADISKNTAYLQMNSLRAEDTAVYYCSRWGGDGFY AMDYWGQGTLVTVSSASTKGPQVQLKQSGRGLVQP SQSLSITCTVSGFSLTTYGIHWVRQSPGKGLEWLG VMWSGGDTDYDAAFISRLSISKDNSKSQVFFKMNS LQANDTGIYYCARYRFYGMDYWGQGTSVTVSS |
| 710 | DVD548L AB004VL | AB074VL | DIQMTQSPSSLSASVGDRVTITCRASQDVNTAVAW YQQKPGKAPKLLIYSASFLYSGVPSRFSGSRSGTD FIL1ISSLQPEDFATYYCQQHYTTPPTFGQGTKVE IKRTVAAPAIQMTQSSSSFSVSLGDRVTIICKASE DIYNRFAWYQQKPGNAPRLLISGAASLEAGVPSRF SGSGSGQDYTLSITSLQTEDVATYYCQQYWSTPWT FGGGTKLEIKR |

Example 2.154

Generation of HER2 (Seq. 1) and PLGF (Seq. 2)
DVD-Igs with Linker Set 2

TABLE 187

| DVD SEQ ID NO | Outer Variable Domain Name | Inner Variable Domain Name | Sequence 123456789012345678901234567890123456789012345 |
|---|---|---|---|
| 711 | DVD555H AB074VH | AB004VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPSVFPLAPEVQLVESGGGL VQPGGSLRLSCAASGFNIKDTYIHWVRQAPGKGLE WVARIYPTNGYTRYADSVKGRFTISADISKNTAYL QMNSLRAEDIAVYYCSRWGGDGFYAMDYWGQGTLV TVSS |
| 712 | DVD555L AB074VL | AB004VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPSVFIFPPDIQMTQSPSSLSASVGDRVT ITCRASQDVNTAVAWYQQKPGKAPKLLIYSASFLY SGVPSRFSGSRSGTDFTLTISSLQPEDFATYYCQQ HYTTPPTFGQGTKVEIKR |
| 713 | DVD556H AB004VH | AB074VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY |

TABLE 187-continued

| DVD SEQ ID NO | Outer Variable Domain Name | Inner Variable Domain Name | Sequence 123456789012345678901234567890123456789012345 |
|---|---|---|---|
| | | | AMDYWGQGTLVTVSSASTKGPSVFPLAPQVQLKQS<br>GPGLVQPSQSLSITCTVSGFSLTTYGIHWVRQSPG<br>KGLEWLGVMWSGGDTDYDAAFISRLSISKDNSKSQ<br>VFFKMNSLQANDTGIYYCARYRFYGMDYWGQGTSV<br>TVSS |
| 714 | DVD556L | AB004VL | AB074VL | DIQMTQSPSSLSASVGDRVTITCRASQDVNTAVAW<br>YQQKPGKAPKLLIYSASFLYSGVPSRFSGSRSGTD<br>FTLTISSLQPEDFATYYCQQHYTTPPTFGQGTKVE<br>IKRTVAAPSVFIFPPAIQMTQSSSSFSVSLGDRVT<br>ITCKASEDIYNRFAWYQQKPGNARRLLISGAASLE<br>AGVPSRFSGSGSGQDYTLSITSLQTEDVATYYCQQ<br>YWSTPWTFGGGTKLEIKR |

Example 2.155

Generation of HER2 (Seq. 1) and PLGF (Seq. 2) DVD-Igs with Linker Set 3

TABLE 188

| DVD SEQ ID NO | Outer Variable Domain Name | Inner Variable Domain Name | Sequence 123456789012345678901234567890123456789012345 |
|---|---|---|---|
| 715 | DVD563H | AB074VH | AB004VH | QVQLKQSGPGLVQPSQSLSITCTVSGFSLTTYGIH<br>WVRQSPGKGLEWLGVMWSGGDTDYDAAFISRLSIS<br>KDNSKSQVFFKMNSLQANDTGIYYCARYRFYGMDY<br>WGQGTSVTVSSASTKGPSVFPLAPEVQLVESGGGL<br>VQPGGSLRLSCAASGFNIKDTYIHWVRQAPGKGLE<br>WVARIYPTNGYTRYADSVKGRFTISADISKNTAYL<br>QMNSLRAEDIAVYYCSRWGGDGFYAMDYWGQGTLV<br>TVSS |
| 716 | DVD563L | AB074VL | AB004VL | AIQMTQSSSSFSVSLGDRVTITCKASEDIYNRFAW<br>YQQKPGNAPRLLISGAASLEAGVPSRFSGSGSGQD<br>YTLSITSLQTEDVATYYCQQYWSTPWTFGGGTKLE<br>IKRTVAAPDIQMTQSPSSLSASVGDRVTITCRASQ<br>DVNTAVAWYQQKPGKARKLLIYSASFLYSGVPSRF<br>SGSRSGTDFTLTISSLQPEDFATYYCQQHYTTPPT<br>FGQGTKVEIKR |
| 717 | DVD564H | AB004VH | AB074VH | EVQLVESGGGLVQPGGSLRLSCAASGFNIKDTYIH<br>WVRQAPGKGLEWVARIYPTNGYTRYADSVKGRFTI<br>SADTSKNTAYLQMNSLRAEDTAVYYCSRWGGDGFY<br>AMDYWGQGTLVTVSSASTKGPSVFPLAPQVQLKQS<br>GPGLVQPSQSLSITCTVSGFSLTTYGIHWVRQSPG<br>KGLEWLGVMWSGGDTDYDAAFISRLSISKDNSKSQ<br>VFFKMNSLQANDTGIYYCARYRFYGMDYWGQGTSV<br>TVSS |
| 718 | DVD564L | AB004VL | AB074VL | DIQMTQSPSSLSASVGDRVTITCRASQDVNTAVAW<br>YQQKPGKAPKLLIYSASFLYSGVPSRFSGSRSGTD<br>FTLTISSLQPEDFATYYCQQHYTTPPTFGQGTKVE<br>IKRTVAAPAIQMTQSSSSFSVSLGDRVTIICKASE<br>DIYNRFAWYQQKPGNAPRLLISGAASLEAGVPSRF<br>SGSGSGQDYTLSITSLQTEDVATYYCQQYWSTPWT<br>FGGGTKLEIKR |

Example 2.156

Generation of HER2 (Seq. 1) and PLGF (Seq. 2)
DVD-Igs with Linker Set 4

TABLE 189

| DVD SEQ ID NO | Outer Variable Domain Name | Inner Variable Domain Name | Sequence 12345678901234567890123456789012345 |
|---|---|---|---|
| 719 DVD571H | AB074VH | AB004VH | QVQLKQSGPGLVQPSQSLSITCTVSGFSLTTYGIH WVRQSPGKGLEWLGVMWSGGDTDYDAAFISRLSIS KDNSKSQVFFKMNSLQANDTGIYYCARYRFYGMDY WGQGTSVTVSSASTKGPEVQLVESGGGLVQPGGSL RLSCAASGFNIKDTYIHWVRQAPGKGLEWVARIYP TNGYTRYADSVKGRFTISADTSKNTAYLQMNSLRA FDTAVYYCSRWGGDGFYAMDYWGQGTLVTVSS |
| 720 DVD571L | AB074VL | AB004VL | AIQMTQSSSSFSVSLGDRVTITCKASEDIYNRFAW YQQKPGNAPRLLISGAASLEAGVPSRFSGSGSGQD YTLSITSLQTEDVATYYCQQYWSTPWTFGGGTKLE IKRTVAAPSVFIFPPDIQMTQSPSSLSASVGDRVT ITCRASQDVNTAVAWYQQKPGKAPKLLIYSASFLY SGVPSRFSGSRSGTDFTLTISSLQPEDFATYYCQQ HYTTPPTFGQGTKVEIKR |
| 721 DVD572H | AB004VH | AB074VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPQVQLKQSGPGLVQP SQSLSITCTVSGFSLTTYGIHWVRQSPGKGLEWLG VMWSGGDTDYDAAFISRLSISKDNSKSQVFFKMNS LQANDTGIYYCARYRFYGMDYWGQGTSVTVSS |
| 722 DVD572L | AB004VL | AB004VL | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPSVFIFPPAIQMTQSSSSFSVSLGDRVT ITCKASEDIYNRFAWYQQKPGNAPRLLISGAASLE AGVPSRFSGSGSGQDYTLSITSLQTEDVATYYCQQ YWSTPWTFGGGTKLEIKR |

Example 2.157

Generation of PLGF (Seq. 1) and VEGF (Seq. 2)
DVD-Igs with Linker Set 1

TABLE 191

| DVD SEQ ID NO | Outer Variable Domain Name | Inner Variable Domain Name | Sequence 12345678901234567890123456789012345 |
|---|---|---|---|
| 723 DVD573H | AB047VH | AB07VH | QVQLQQSGAELVKPGASVKISCKASGYTFTDYYINWV KLAPGQGLEWIGWIYPGSGNTKYNEKFKGKATLTIDT SSSTAYMQLSSLISEDTAVYECVRDSPFFDYWGQGTL LTVSSASTKGPEVQLVESGGGLVQPGGSLRLSCAASG FTISDYWIHWVRQAPGKGLEWVAGITPAGGYTYADS VKGRFTISADTSKNTAYLQMNSLRAEDTAVYYCARFV FFLPYAMDYWGQGTLVTVSS |
| 724 DVD573L | AB047VL | AB070VL | DIVLTQSPDSLAVSLGERVTMNCKSSQSLLNSGMRKS FLAWYQQKPGQSPKLLIYWASTRESGVPDRFTGSGSG TDFTLTISSVQAEDVAVYYCKQSYHLFTFGSGTKLEI KRTVAAPDIQMTQSPSSLSASVGDRVTITCRASQDVS TAVAWYQQKPGKAPKLLIYSASFLYSGVPSRFSGSGS GTDFTLTISSLQPEDFATYYCQQSYTTPPTFGQGTKV EIKR |
| 725 DVD574H | AB070VH | AB047VH | EVQLVESGGGLVQPGGSLRLSCAASGFTISDYWIHWV RQAPGKGLEWVAGITPAGGYTYADSVKGRFTISADT SKNTAYLQMNSLRAEDTAVYYCARFVFFLPYAMDYWG QGTLVTVSSASTKGPQVQLQQSGAELVKPGASVKISC |

TABLE 191-continued

| DVD SEQ ID NO | Outer Variable Domain Name | Inner Variable Domain Name | Sequence 123456789012345678901234567890123456789012345 |
|---|---|---|---|
| | | | KASGYTFTDYYINWVKLAPGQGLEWIGWIYPGSGNTK YNEKFKGKATLTIDTSSSTAYMQLSSLTSEDTAVYFC VRDSPFFDYWGQGTLLTVSS |
| 726 DVD574L | AB070VL | AB047VL | DIQMTQSPSSLSASVGDRVTITCRASQDVSTAVAWYQ QKPGKAPKLLIYSASFLYSGVPSRFSGSGSGTDFTLT ISSLQPEDFATYYCQQSYTTPPTFGQGTKVEIKRTVA APDIVLTQSPDSLAVSLGERVTMNCKSSQSLLNSGMR KSFLAWYQQKPGQSPKLLIYWASTRESGVPDRFTGSG SGTDFTLTISSVQAEDVAVYYCKQSYHLFTFGSGTKL EIKR |

Example 2.158

Generation of PLGF (Seq. 1) and VEGF (Seq. 2) DVD-Igs with Linker Set 2

TABLE 192

| DVD SEQ ID NO | Outer Variable Domain Name | Inner Variable Domain Name | Sequence 123456789012345678901234567890123456789012345 |
|---|---|---|---|
| 727 DVD581H | AB047VH | AB070VH | QVQLQQSGAELVKPGASVKISCKASGYTFTDYYIN WVKLAPGQGLEWIGWIYRGSGNTKYNEKFKGKATL TIDTSSSTAYMQLSSLTSEDTAVYFCVRDSPFFDY WGQGTLLTVSSASTKGPSVFPLAPEVQLVESGGGL VQPGGSLRLSCAASGFTISDYWIHWVRQAPGKGLE WVAGITPAGGYTYYADSVKGRFTISADISKNTAYL QMNSLRAEDTAVYYCARFVFFLPYAMDYWGQGTLV TVSS |
| 728 DVD581L | AB047VL | AB070VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPSVFIFPPDIQMTQSPSSLSASV GDRVTITCRASQDVSTAVAWYQQKPGKAPKLLIYS ASFLYSGVPSRFSGSGSGTDFTLTISSLQPEDFAT YYCQQSYTTPPTFGQGTKVEIKR |
| 729 DVD582H | AB070VH | AB047VH | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPQVQLQQS GAELVKPGASVKISCKASGYTFTDYYINWVKLAPG QGLEWIGWIYPGSGNTKYNEKFKGKATLTIDTSSS TAYMQLSSLISEDTAVYFCVRDSPFFDYWGQGTLL TVSS |
| 730 DVD582L | AB070VL | AB047VL | DIQMTQSRSSLSASVGDRVTITCRASQDVSTAVAW YQQKRGKARKLLIYSASFLYSGVPSRFSGSGSGTD FILlISSLQPEDFATYYCQQSYTTPPTFGQGTKVE IKRTVAAPSVFIFPPDIVLTQSPDSLAVSLGERVT MNCKSSQSLLNSGMRKSFLAWYQQKPGQSPKLLIY WASTRESGVPDRFTGSGSGTDFTLTISSVQAEDVA VYYCKQSYHLFTFGSGTKLEIKR |

Example 2.159

Generation of PLGF (Seq. 1) and VEGF (Seq. 2)
DVD-Igs with Linker Set 3

TABLE 193

| DVD SEQ ID NO | Outer Variable Domain Name | Inner Variable Domain Name | Sequence 123456789012345678901234567890 12345 |
|---|---|---|---|
| 731 | DVD589VH AB047VH | AB070VH | QVQLQQSGAELVKRGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPSVFPLAPEVQLVESGGGL VQPGGSLRLSCAASGFTISDYWIHWVRQAPGKGLE WVAGITPAGGYTYYADSVKGRFTISADISKNTAYL QMNSLRAEDIAVYYCARFVFFLPYAMDYWGQGTLV TVSS |
| 732 | DVD589VL AB047VL | AB070VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPDIQMTQSPSSLSASVGDRVTIT CRASQDVSTAVAWYQQKPGKAPKLLIYSASFLYSG VPSRFSGSGSGTDFTLTISSLQPEDFATYYCQQSY TTPPTFGQGTKVEIKR |
| 733 | DVD590VH AB070VH | AB047VH | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPQVQLQQS GAELVKPGASVKISCKASGYTFTDYYINWVKLAPG QGLEWIGWIYPGSGNTKYNEKFKGKATLTIDTSSS TAYMQLSSLTSEDTAVYFCVRDSPFFDYWGQGTLL TVSS |
| 734 | DVD590VL AB070VL | AB047VL | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPDIVLTQSPDSLAVSLGERVTMNCKSSQ SLLNSGMRKSFLAWYQQKPGQSPKLLIYWASTRES GVPDRFTGSGSGTDFTLTISSVQAEDVAVYYCKQS YHLFTFGSGTKLEIKR |

Example 2.160

Generation of PLGF (Seq. 1) and VEGF (Seq. 2)
DVD-Igs with Linker Set 4

TABLE 194

| DVD SEQ ID NO | Outer Variable Domain Name | Inner Variable Domain Name | Sequence 123456789012345678901234567890 12345 |
|---|---|---|---|
| 735 | DVD597VH AB047VH | AB070VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPEVQLVESGGGLVQPGGSL RLSCAASGFTISDYWIHWVRQAPGKGLEWVAGITP AGGYTYYADSVKGRFTISADTSKNTAYLQMNSLRA EDTAVYYCARFVFFLPYAMDYWGQGTLVTVSS |
| 736 | DVD597VL AB047VL | AB070VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPSVFIFPPDIQMTQSPSSLSASV GDRVTITCRASQDVSTAVAWYQQKPGKAPKLLIYS ASFLYSGVPSRFSGSGSGTDFTLTISSLQPEDFAT YYCQQSYTTPPTFGQGTKVEIKR |
| 737 | DVD598VH AB070VH | AB047VH | EVQLVESGGGLVQPGGSLRLSCAASGFTISDYWIH WVRQAPGKGLEWVAGITPAGGYTYYADSVKGRFTI |

TABLE 194-continued

| DVD SEQ ID NO | Outer Variable Domain Name | Inner Variable Domain Name | Sequence 12345678901234567890123456789012345 |
|---|---|---|---|
| | | | SADISKNTAYLQMNSLRAEDTAVYYCARFVFFLPY<br>AMDYWGQGTLVTVSSASTKGPQVQLQQSGAELVKP<br>GASVKISCKASGYTFTDYYINWVKLAPGQGLEWIG<br>WIYPGSGNTKYNEKFKGKATLTIDTSSSTAYMQLS<br>SLTSEDTAVYFCVRDSPFFDYWGQGTLLTVSS |
| 738 | DVD598VL | AB070VL AB047VL | DIQMTQSPSSLSASVGDRVTITCRASQDVSTAVAW<br>YQQKPGKAPKLLIYSASFLYSGVPSRFSGSGSGTD<br>FIL1ISSLQPEDFATYYCQQSYTTPPTFGQGTKVE<br>IKRTVAAPSVFIFPPDIVLTQSPDSLAVSLGERVT<br>MNCKSSQSLLNSGMRKSFLAWYQQKPGQSPKLLIY<br>WASTRESGVPDRFTGSGSGTDFTLTISSVQAEDVA<br>VYYCKQSYHLFTFGSGTKLEIKR |

Example 2.161

Generation of PLGF (Seq. 1) and VEGF (Seq. 3) DVD-Igs with Linker Set 1

TABLE 195

| DVD SEQ ID NO | Outer Variable Domain Name | Inner Variable Domain Name | Sequence 12345678901234567890123456789012345 |
|---|---|---|---|
| 739 | DVD575H | AB047VH AB071VH | QVQLQQSGAELVKPGASVKISCKASGYTFTDYYIN<br>WVKLAPGQGLEWIGWIYPGSGNTKYNEKFKGKATL<br>TIDTSSSTAYMQLSSLTSEDTAVYFCVRDSPFFDY<br>WGQGTLLTVSSASTKGPEVQLVESGGGLVQPGGSL<br>RLSCAASGFTINASWIHWVRQARGKGLEWVGAIYP<br>YSGYTNYADSVKGRFTISADTSKNTAYLQMNSLRA<br>EDTAVYYCARWGHSTSPWAMDYWGQGTLVTVSS |
| 740 | DVD575L | AB047VL AB071VL | DIVLTQSPDSLAVSLGERVTMNCKSSQSLLNSGMR<br>KSFLAWYQQKPGQSPKLLIYWASTRESGVRDRFTG<br>SGSGTDFTLTISSVQAEDVAVYYCKQSYHLFTFGS<br>GTKLEIKRTVAAPDIQMTQSPSSLSASVGDRVTIT<br>CRASQVIRRSLAWYQQKPGKAPKLLIYAASNLASG<br>VPSRFSGSGSGTDFTLTISSLQPEDFATYYCQQSN<br>TSPLTFGQGTKVEIKR |
| 741 | DVD576H | AB071VH AB047VH | EVQLVESGGGLVQPGGSLRLSCAASGFTINASWIH<br>WVRQAPGKGLEWVGAIYPYSGYTNYADSVKGRFTI<br>SADTSKNTAYLQMNSLRAEDTAVYYCARWGHSTSP<br>WAMDYWGQGTLVTVSSASTKGPQVQLQQSGAELVK<br>PGASVKISCKASGYTFTDYYINWVKLAPGQGLEWI<br>GWIYPGSGNTKYNEKFKGKATLTIDTSSSTAYMQL<br>SSLTSEDTAVYFCVRDSPFFDYWGQGTLLTVSS |
| 742 | DVD576L | AB071VL AB047VL | DIQMTQSPSSLSASVGDRVTITCRASQVIRRSLAW<br>YQQKPGKAPKLLIYAASNLASGVPSRFSGSGSGTD<br>FTLTISSLQPEDFATYYCQQSNTSPLTFGQGTKVE<br>IKRTVAAPDIVLTQSPDSLAVSLGERVTMNCKSSQ<br>SLLNSGMRKSFLAWYQQKPGQSPKLLIYWASTRES<br>GVPDRFTGSGSGTDFTLTISSVQAEDVAVYYCKQS<br>YHLFTFGSGTKLEIKR |

Example 2.162

Generation of PLGF (Seq. 1) and VEGF (Seq. 3)
DVD-Igs with Linker Set 2

TABLE 196

| DVD SEQ ID NO | Outer Variable Domain Name | Inner Variable Domain Name | Sequence 123456789012345678901234567890123 45 |
|---|---|---|---|
| 743 | DVD583H AB047VH | AB071VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPSVFPLAPEVQLVESGGGL VQPGGSLRLSCAASGFTINASWIHWVRQAPGKGLE WVGAIYPYSGYTNYADSVKGRFTISADISKNTAYL QMNSLRAEDTAVYYCARWGHSTSPWAMDYWGQGTL VTVSS |
| 744 | DVD583L AB047VL | AB071VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPSVFIFPPDIQMTQSPSSLSASV GDRVTITCRASQVIRRSLAWYQQKPGKAPKLLIYA ASNLASGVPSRFSGSGSGTDFTLTISSLQPEDFAT YYCQQSNTSPLTFGQGTKVEIKR |
| 745 | DVD584H AB071VH | AB047VH | EVQLVESGGGLVQPGGSLRLSCAASGFTINASWIH WVRQAPGKGLEWVGAIYPYSGYTNYADSVKGRFTI SADISKNTAYLQMNSLRAEDTAVYYCARWGHSTSP WAMDYWGQGTLVTVSSASTKGPSVFPLAPQVQLQQ SGAELVKPGASVKISCKASGYTFTDYYINWVKLAP GQGLEWIGWIYPGSGNTKYNEKFKGKATLTIDTSS STAYMQLSSLISEDTAVYFCVRDSPFFDYWGQGTL LTVSS |
| 746 | DVD584L AB071VL | AB047VL | DIQMIQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPSVFIFPPDIVLTQSRDSLAVSLGERVT MNCKSSQSLLNSGMRKSFLAWYQQKPGQSPKLLIY WASTRESGVPDRFTGSGSGTDFTLTISSVQAEDVA VYYCKQSYHLFTFGSGTKLEIKR |

Example 2.163

Generation of PLGF (Seq. 1) and VEGF (Seq. 3)
DVD-Igs with Linker Set 3

TABLE 197

| DVD SEQ ID NO | Outer Variable Domain Name | Inner Variable Domain Name | Sequence 123456789012345678901234567890123 45 |
|---|---|---|---|
| 747 | DVD591VH AB047VH | AB071VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPSVFPLAPEVQLVESGGGL VQPGGSLRLSCAASGFTINASWIHWVRQAPGKGLE WVGAIYPYSGYTNYADSVKGRFTISADTSKNTAYL QMNSLRAEDTAVYYCARWGHSTSPWAMDYWGQGTL VTVSS |
| 748 | DVD591VL AB047VL | AB071VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPDIQMTQSPSSLSASVGDRVTIT CRASQVIRRSLAWYQQKPGKAPKLLIYAASNLASG VPSRFSGSGSGTDFTLTISSLQPEDFATYYCQQSN TSPLTFGQGTKVEIKR |

TABLE 197-continued

| DVD SEQ ID NO | Outer Variable Domain Name | Inner Variable Domain Name | Sequence |
|---|---|---|---|
| 749 | DVD592VH AB071VH | AB047VH | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPSVFPLAPQVQLQQ SGAELVKPGASVKISCKASGYTFTDYYINWVKLAP GQGLEWIGWIYPGSGNTKYNEKFKGKATLTIDTSS STAYMQLSSLTSEDTAVYFCVRDSPFFDYWGQGTL LTVSS |
| 750 | DVD592VL AB071VL | AB047VL | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPDIVLTQSPDSLAVSLGERVTMNCKSSQ SLLNSGMRKSFLAWYQQKPGQSPKLLIYWASTRES GVPDRFTGSGSGTDFTLTISSVQAEDVAVYYCKQS YHLFTFGSGTKLEIKR |

Example 2.164

Generation of PLGF (Seq. 1) and VEGF (Seq. 3) DVD-Igs with Linker Set 4

TABLE 198

| DVD SEQ ID NO | Outer Variable Domain Name | Inner Variable Domain Name | Sequence |
|---|---|---|---|
| 751 | DVD599VH AB047VH | AB071VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPEVQLVESGGGLVQPGGSL RLSCAASGFTINASWIHWVRQAPGKGLEWVGAIYP YSGYTNYADSVKGRFTISADTSKNTAYLQMNSLRA EDTAVYYCARWGHSTSPWAMDYWGQGTLVTVSS |
| 752 | DVD599VL AB047VL | AB071VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPSVFIFPPDIQMTQSPSSLSASV GDRVTITCRASQVIRRSLAWYQQKPGKAPKLLIYA ASNLASGVPSRFSGSGSGTDFTLTISSLQPEDFAT YYCQQSNTSPLTFGQGTKVEIKR |
| 753 | DVD600VH AB071VH | AB047VH | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPQVQLQQSGAELVK PGASVKISCKASGYTFTDYYINWVKLAPGQGLEWI GWIYPGSGNTKYNEKFKGKATLTIDTSSSTAYMQL SSLTSEDTAVYFCVRDSPFFDYWGQGTLLTVSS |
| 754 | DVD600VL AB071VL | AB047VL | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPSVFIFPPDIVLTQSRDSLAVSLGERVT MNCKSSQSLLNSGMRKSFLAWYQQKPGQSPKLLIY WASTRESGVPDRFTGSGSGTDFTLTISSVQAEDVA VYYCKQSYHLFTFGSGTKLEIKR |

Example 2.165

Generation of HER2 (Seq. 1) and PLGF (Seq. 1)
DVD-Igs with Linker Set 1

TABLE 199

| DVD SEQ ID NO | Outer Variable Domain Name | Inner Variable Domain Name | Sequence 123456789012345678901234567890123456789012345 |
|---|---|---|---|
| 755 | DVD577H AB047VH | AB004VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPEVQLVESGGGLVQPGGSL RLSCAASGFNIKDTYIHWVRQAPGKGLEWVARIYP TNGYTRYADSVKGRFTISADTSKNTAYLQMNSLRA EDTAVYYCSRWGGDGFYAMDYWGQGTLVTVSS |
| 756 | DVD577L AB047VL | AB004VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPDIQMTQSPSSLSASVGDRVTIT CRASQDVNTAVAWYQQKPGKAPKLLIYSASFLYSG VPSRFSGSRSGTDFTLTISSLQPEDFATYYCQQHY TTPPTFGQGTKVEIKR |
| 757 | DVD578H AB004VH | AB047VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPQVQLQQSGAELVKP GASVKISCKASGYTFTDYYINWVKLAPGQGLEWIG WIYPGSGNTKYNEKFKGKATLTIDTSSSTAYMQLS SLTSEDTAVYFCVRDSPFFDYWGQGTLLTVSS |
| 758 | DVD578L AB004VL | AB047VL | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPDIVLTQSPDSLAVSLGERVTMNCKSSQ SLLNSGMRKSFLAWYQQKRGQSPKLLIYWASTRES GVPDRFTGSGSGTDFTLTISSVQAEDVAVYYCKQS YHLFTFGSGTKLEIKR |

Example 2.166

Generation of HER2 (Seq. 1) and PLGF (Seq. 1)
DVD-Igs with Linker Set 2

TABLE 200

| DVD SEQ ID NO | Outer Variable Domain Name | Inner Variable Domain Name | Sequence 123456789012345678901234567890123456789012345 |
|---|---|---|---|
| 759 | DVD585H AB047VH | AB004VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPSVFPLAPEVQLVESGGGL VQPGGSLRLSCAASGFNIKDTYIHWVRQAPGKGLE WVARIYPTNGYTRYADSVKGRFTISADTSKNTAYL QMNSLRAEDTAVYYCSRWGGDGFYAMDYWGQGTLV TVSS |
| 760 | DVD585L AB047VL | AB004VL | DIVLTQSPDSLAVSLGERVTMNCKSSQSLLNSGMR KSFLAWYQQKPGQSPKLLIYWASTRESGVRDRFTG SGSGTDFTLTISSVQAEDVAVYYCKQSYHLFTFGS GTKLEIKRTVAAPSVFIFPPDIQMTQSPSSLSASV GDRVTITCRASQDVNTAVAWYQQKPGKAPKLLIYS ASFLYSGVRSPFSGSRSGTDFTLTISSLQPEDFAT YYCQQHYTTPPTFGQGTKVEIKR |
| 761 | DVD586H AB004VH | AB047VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY |

TABLE 200-continued

| DVD SEQ ID NO | Outer Variable Domain Name | Inner Variable Domain Name | Sequence 123456789012345678901234567890123456789012345 |
|---|---|---|---|
| | | | AMDYWGQGTLVTVSSASTKGPSVFPLAPQVQLQQS GAELVKPGASVKISCKASGYTFTDYYINWVKLAPG QGLEWIGWIYPGSGNTKYNEKFKGKATLIDTSSS TAYMQLSSLTSEDTAVYFCVRDSPFFDYWGQGTLL TVSS |
| 762 DVD586L | AB004VL | AB047VL | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPSVFIFPPDIVLTQSPDSLAVSLGERVT MNCKSSQSLLNSGMRKSFLAWYQQKPGQSPKLLIY WASTRESGVPDRFTGSGSGTDFTLTISSVQAEDVA VYYCKQSYHLFTFGSGTKLEIKR |

Example 2.167

Generation of HER2 (Seq. 1) and PLGF (Seq. 1) DVD-Igs with Linker Set 3

TABLE 201

| DVD SEQ ID NO | Outer Variable Domain Name | Inner Variable Domain Name | Sequence 123456789012345678901234567890123456789012345 |
|---|---|---|---|
| 763 DVD593VH | AB047VH | AB004VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPSVFPLAPEVQLVESGGGL VQPGGSLRLSCAASGFNIKDTYIHWVRQAPGKGLE WVARIYPTNGYTRYADSVKGRFTISADISKNTAYL QMNSLRAEDTAVYYCSRWGGDGFYAMDYWGQGTLV TVSS |
| 764 DVD593VL | AB047VL | AB004VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPDIQMTQSPSSLSASVGDRVTIT CRASQDVNTAVAWYQQKPGKAPKLLIYSASFLYSG VPSRFSGSRSGTDFTLTISSLQPEDFATYYCQQHY TTPPTFGQGTKVEIKR |
| 765 DVD594VH | AB004VH | AB047VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPSVFPLAPQVQLQQS GAELVKPGASVKISCKASGYTFTDYYINWVKLAPG QGLEWIGWIYPGSGNTKYNEKFKGKATLIDTSSS TAYMQLSSLTSEDTAVYFCVRDSPFFDYWGQGTLL TVSS |
| 766 DVD594VL | AB004VL | AB047VL | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPDIVLTQSPDSLAVSLGERVTMNCKSSQ SLLNSGMRKSFLAWYQQKPGQSPKLLIYWASTRES GVPDRFTGSGSGTDFTLTISSVQAEDVAVYYCKQS YHLFTFGSGTKLEIKR |

Example 2.168

Generation of HER2 (Seq. 1) and PLGF (Seq. 1)
DVD-Igs with Linker Set 4

TABLE 202

| DVD SEQ ID NO | Outer Variable Domain Name | Inner Variable Domain Name | Sequence 123456789012345678901234567890123456789012345 |
|---|---|---|---|
| 767 | DVD601VH AB047VH | AB004VH | QVQLQQSGAELVKPGASVKISCKASGYTFTDYYIN WVKLAPGQGLEWIGWIYPGSGNTKYNEKFKGKATL TIDTSSSTAYMQLSSLTSEDTAVYFCVRDSPFFDY WGQGTLLTVSSASTKGPEVQLVESGGGLVQPGGSL RLSCAASGFNIKDTYIHWVRQAPGKGLEWVARIYP TNGYTRYADSVKGRFTISADTSKNTAYLQMNSLRA FDTAVYYCSRWGGDGFYAMDYWGQGTLVTVSS |
| 768 | DVD601VL AB047VL | AB004VL | DIVLTQSPDSLAVSLGERVTMNCKSSQSLLNSGMR KSFLAWYQQKPGQSPKLLIYWASTRESGVPDRFTG SGSGTDFTLTISSVQAEDVAVYYCKQSYHLFTFGS GTKLEIKRTVAAPSVFIFPPDIQMTQSPSSLSASV GDRVTITCRASQDVNTAVAWYQQKPGKAPKLLIYS ASFLYSGVPSRFSGSRSGTDFTLTISSLQPEDFAT YYCQQHYTTPPTFGQGTKVEIKR |
| 769 | DVD602VH AB004VH | AB047VH | EVQLVESGGGLVQPGGSLRLSCAASGFNIKDTYIH WVRQAPGKGLEWVARIYRTNGYTRYADSVKGRFTI SADTSKNTAYLQMNSLRAEDTAVYYCSRWGGDGFY AMDYWGQGTLVTVSSASTKGPQVQLQQSGAELVKP GASVKISCKASGYTFTDYYINWVKLAPGQGLEWIG WIYPGSGNTKYNEKFKGKATLTIDTSSSTAYMQLS SLTSEDTAVYFCVRDSPFFDYWGQGTLLTVSS |
| 770 | DVD602VL AB004VL | AB047VL | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPSVFIFPPDIVLTQSPDSLAVSLGERVT MNCKSSQSLLNSGMRKSFLAWYQQKPGQSPKLLIY WASTRESGVPDRFTGSGSGTDFTLTISSVQAEDVA VYYCKQSYHLFTFGSGTKLEIKR |

Example 2.169

Generation of HGF (Seq. 1) and VEGF (Seq. 2)
DVD-Igs with Linker Set 1

TABLE 203

| DVD SEQ ID NO | Outer Variable Domain Name | Inner Variable Domain Name | Sequence 123456789012345678901234567890123456789012345 |
|---|---|---|---|
| 771 | DVD643H AB012VH | AB070VH | QVQLVESGGGLVKPGGSLRLSCAASGFTFSDYYMS WIRQAPGKGLEWVSYISSSGSTIYYADSVKGRFTI SRDNAKNSLYLQMNSLRAEDTAVYYCARDEYNSGW YVLFDYWGQGTLVTVSSASTKGPSVFPLAPEVQLV ESGGGLVQPGGSLRLSCAASGFTISDYWIHWVRQA PGKGLEWVAGITPAGGYTYYADSVKGRFTISADIS KNTAYLQMNSLRAEDTAVYYCARFVFFLPYAMDYW GQGTLVTVSS |
| 772 | DVD643L AB012VL | AB070VL | DIQMTQSPSSVSASVGDRVTITCRASQGISSWLAW YQQKPGKAPNLLIYEASSLQSGVPSRFGGSGSGTD FTLTISSLQPEDFATYYCQQANGFPWTFGQGTKVE IKRTVAAPSVFIFPPDIQMTQSPSSLSASVGDRVT ITCRASQDVSTAVAWYQQKPGKAPKLLIYSASFLY SGVPSRFSGSGSGTDFTLTISSLQPEDFATYYCQQ SYTTPPTFGQGTKVEIKR |
| 773 | DVD644H AB070VH | AB012VH | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY |

TABLE 203-continued

| DVD SEQ ID NO | DVD Variable Domain Name | Outer Variable Domain Name | Inner Variable Domain Name | Sequence 123456789012345678901234567890123456789012345 |
|---|---|---|---|---|
| | | | | AMDYWGQGTLVTVSSASTKGPSVFPLAPQVQLVES<br>GGGLVKPGGSLRLSCAASGFTFSDYYMSWIRQAPG<br>KGLEWVSYISSSGSTIYYADSVKGRFTISRDNAKN<br>SLYLQMNSLRAEDTAVYYCARDEYNSGWYVLFDYW<br>GQGTLVTVSS |
| 774 | DVD644L | AB070VL | AB012VL | DIQMTQSPSSLSASVGDRVTITCRASQDVSTAVAW<br>YQQKPGKAPKLLIYSASFLYSGVPSRFSGSGSGTD<br>FTLTISSLQPEDFATYYCQQSYTTPPTFGQGTKVE<br>IKRTVAAPSVFIFPPDIQMTQSPSSVSASVGDRVT<br>ITCRASQGISSWLAWYQQKPGKAPNLLIYEASSLQ<br>SGVPSRFGGSGSGTDFTLTISSLQPEDFATYYCQQ<br>ANGFPWTFGQGTKVEIKR |

Example 2.170

Generation of HGF (Seq. 1) and VEGF (Seq. 2) DVD-Igs with Linker Set 2

TABLE 204

| DVD SEQ ID NO | DVD Variable Domain Name | Outer Variable Domain Name | Inner Variable Domain Name | Sequence 123456789012345678901234567890123456789012345 |
|---|---|---|---|---|
| 775 | DVD649H | AB012VH | AB070VH | QVQLVESGGGLVKPGGSLRLSCAASGFTFSDYYMS<br>WIRQAPGKGLEWVSYISSSGSTIYYADSVKGRFTI<br>SRDNAKNSLYLQMNSLRAEDTAVYYCARDEYNSGW<br>YVLFDYWGQGTLVTVSSASTKGPSVFPLAPEVQLV<br>ESGGGLVQPGGSLRLSCAASGFTISDYWIHWVRQA<br>PGKGLEWVAGITPAGGYTYYADSVKGRFTISADTS<br>KNTAYLQMNSLRAEDTAVYYCARFVFFLPYAMDYW<br>GQGTLVTVSS |
| 776 | DVD649L | AB012VL | AB070VL | DIQMTQSPSSVSASVGDRVTITCRASQGISSWLAW<br>YQQKPGKAPNLLIYEASSLQSGVPSRFGGSGSGTD<br>FTLTISSLQPEDFATYYCQQANGFPWTFGQGTKVE<br>IKRTVAAPDIQMTQSPSSLSASVGDRVTITCRASQ<br>DVSTAVAWYQQKPGKAPKLLIYSASFLYSGVPSRF<br>SGSGSGTDFTLTISSLQPEDFATYYCQQSYTTPPT<br>FGQGTKVEIKR |
| 777 | DVD650H | AB070VH | AB012VH | EVQLVESGGGLVQPGGSLRLSCAASGFTISDYWIH<br>WVRQAPGKGLEWVAGITPAGGYTYYADSVKGRFTI<br>SADTSKNTAYLQMNSLRAEDTAVYYCARFVFFLPY<br>AMDYWGQGTLVTVSSASTKGPSVFPLAPQVQLVES<br>GGGLVKPGGSLRLSCAASGFTFSDYYMSWIRQAPG<br>KGLEWVSYISSSGSTIYYADSVKGRFTISRDNAKN<br>SLYLQMNSLRAEDTAVYYCARDEYNSGWYVLFDYW<br>GQGTLVTVSS |
| 778 | DVD650L | AB070VL | AB012VL | DIQMTQSPSSLSASVGDRVTITCRASQDVSTAVAW<br>YQQKPGKAPKLLIYSASFLYSGVPSRFSGSGSGTD<br>FTLTISSLQPEDFATYYCQQSYTTPPTFGQGTKVE<br>IKRTVAAPDIQMTQSPSSVSASVGDRVTITCRASQ<br>GISSWLAWYQQKPGKAPNLLIYEASSLQSGVPSRF<br>GGSGSGTDFTLTISSLQPEDFATYYCQQANGFPWT<br>EGQGTKVEIKR |

Example 2.171

Generation of HGF (Seq. 1) and VEGF (Seq. 2)
DVD-Igs with Linker Set 3

TABLE 205

| DVD SEQ ID NO | DVD Variable Domain Name | Outer Variable Domain Name | Inner Variable Domain Name | Sequence 123456789012345678901234567890123456789012345 |
|---|---|---|---|---|
| 779 | DVD655H | AB012VH | AB070VH | QVQLVESGGGLVKPGGSLRLSCAASGFTFSDYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS |
| 780 | DVD655L | AB012VL | AB070VL | DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR |
| 781 | DVD656H | AB070VH | AB012VH | EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS |
| 782 | DVD656L | AB070VL | AB012VL | DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR |

Example 2.172

Generation of HGF (Seq. 1) and VEGF (Seq. 2)
DVD-Igs with Linker Set 4

TABLE 206

| DVD SEQ ID NO | DVD Variable Domain Name | Outer Variable Domain Name | Inner Variable Domain Name | Sequence 123456789012345678901234567890123456789012345 |
|---|---|---|---|---|
| 783 | DVD709VH | AB012VH | AB070VH | QVQLVESGGGLVKPGGSLRLSCAASGFTFSDYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS |
| 784 | DVD709VL | AB012VL | AB070VL | DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDIQMTQSRSSLSASVGDRVTITCRASQDVSTAVAWYQQKPGKAPKLLIYSASFLYSGVPSRFSGSGSGTDFTLTISSLQPEDFATYYCQQSYTTPPTEGQGTKVEIKR |

TABLE 206-continued

| DVD SEQ ID NO | Outer Variable Domain Name | Inner Variable Domain Name | Sequence 123456789012345678901234567890123456 |
|---|---|---|---|
| 785 | DVD710VH AB070VH | AB012VH | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPQVQLVESGGGLVKP GGSLRLSCAASGFTFSDYYMSWIRQAPGKGLEWVS YISSSGSTIYYADSVKGRFTISRDNAKNSLYLQMN SLRAEDTAVYYCARDEYNSGWYVLFDYWGQGTLVT VSS |
| 786 | DVD710VL AB070VL | AB012VL | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPDIQMTQSPSSVSASVGDRVTITCRASQ GISSWLAWYQQKPGKAPNLLIYEASSLQSGVPSRF GGSGSGTDFTLTISSLQPEDFATYYCQQANGFPWT FGQGTKVEIKR |

Example 2.173

Generation of HGF (Seq. 1) and VEGF (Seq. 3) DVD-Igs with Linker Set 1

TABLE 207

| DVD SEQ ID NO | Outer Variable Domain Name | Inner Variable Domain Name | Sequence 123456789012345678901234567890123456 |
|---|---|---|---|
| 787 | DVD645H AB012VH | AB071VH | QVQLVESGGGLVKPGGSLRLSCAASGFTFSDYYMS WIRQAPGKGLEWVSYISSSGSTIYYADSVKGRFTI SRDNAKNSLYLQMNSLRAEDTAVYYCARDEYNSGW YVLFDYWGQGTLVTVSSASTKGPSVFPLAPEVQLV ESGGGLVQPGGSLRLSCAASGFTINASWIHWVRQA PGKGLEWVGAIYPYSGYTNYADSVKGRFTISADTS KNTAYLQMNSLRAEDTAVYYCARWGHSTSPWAMDY WGQGTLVTVSS |
| 788 | DVD645L AB012VL | AB071VL | DIQMTQSPSSVSASVGDRVTITCRASQGISSWLAW YQQKPGKAPNLLIYEASSLQSGVPSRFGGSGSGTD FTLTISSLQPEDFATYYCQQANGFPWTFGQGTKVE IKRTVAAPSVFIFPPDIQMTQSPSSLSASVGDRVT ITCRASQVIRRSLAWYQQKPGKAPKLLIYAASNLA SGVPSRFSGSGSGTDFTLTISSLQPEDFATYYCQQ SNTSPLTFGQGTKVEIKR |
| 789 | DVD646H AB071VH | AB012VH | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPSVFPLAPQVQLVE SGGGLVKPGGSLRLSCAASGFTFSDYYMSWIRQAP GKGLEWVSYISSSGSTIYYADSVKGRFTISRDNAK NSLYLQMNSLRAEDTAVYYCARDEYNSGWYVLFDY WGQGTLVTVSS |
| 790 | DVD646L AB071VL | AB012VL | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPSVFIFPPDIQMTQSPSSVSASVGDRVT ITCRASQGISSWLAWYQQKPGKAPNLLIYEASSLQ SGVPSRFGGSGSGTDFTLTISSLQPEDFATYYCQQ ANGFPWTFGQGTKVEIKR |

Example 2.174

Generation of HGF (Seq. 1) and VEGF (Seq. 3)
DVD-Igs with Linker Set 2

TABLE 208

| DVD SEQ ID NO | Outer Variable Domain Name | Inner Variable Domain Name | Sequence 123456789012345678901234567890123445 |
|---|---|---|---|
| 791 | DVD651H | AB012VH | AB071VH | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPSVFPLAPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS |
| 792 | DVD651L | AB012VL | AB071VL | DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR |
| 793 | DVD652H | AB071VH | AB012VH | EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS |
| 794 | DVD652L | AB071VL | AB012VL | DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR |

Example 2.175

Generation of HGF (Seq. 1) and VEGF (Seq. 3)
DVD-Igs with Linker Set 3

TABLE 209

| DVD SEQ ID NO | Outer Variable Domain Name | Inner Variable Domain Name | Sequence 123456789012345678901234567890123445 |
|---|---|---|---|
| 795 | DVD657H | AB012VH | AB071VH | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSRWAMDYWGQGTLVTVSS |
| 796 | DVD657L | AB012VL | AB071VL | DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPSVFIFPPDIQMTQSRSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR |

TABLE 209-continued

| DVD SEQ ID NO | Outer Variable Domain Name | Inner Variable Domain Name | Sequence 123456789012345678901234567890123 45 |
|---|---|---|---|
| 797 | DVD658H AB071VH | AB012VH | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPQVQLVESGGGLVK PGGSLRLSCAASGFTFSDYYMSWIRQAPGKGLEWV SYISSSGSTIYYADSVKGRFTISRDNAKNSLYLQM NSLRAEDTAVYYCARDEYNSGWYVLFDYWGQGTLV TVSS |
| 798 | DVD658L AB071VL | AB012VL | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPSVFIFPPDIQMTQSPSSVSASVGDRVT ITCRASQGISSWLAWYQQKPGKAPNLLIYEASSLQ SGVPSRFGGSGSGTDFTLTISSLQPEDFATYYCQQ ANGFPWTFGQGTKVEIKR |

Example 2.176

Generation of HGF (Seq. 1) and VEGF (Seq. 3) DVD-Igs with Linker Set 4

TABLE 210

| DVD SEQ ID NO | Outer Variable Domain Name | Inner Variable Domain Name | Sequence 123456789012345678901234567890123 45 |
|---|---|---|---|
| 799 | DVD711VH AB012VH | AB071VH | QVQLVESGGGLVKPGGSLRLSCAASGFTFSDYYMS WIRQAPGKGLEWVSYISSSGSTIYYADSVKGRFTI SRDNAKNSLYLQMNSLRAEDTAVYYCARDEYNSGW YVLFDYWGQGTLVTVSSASTKGPEVQLVESGGGLV QPGGSLRLSCAASGFTINASWIHWVRQAPGKGLEW VGAIYPYSGYTNYADSVKGRFTISADTSKNTAYLQ MNSLRAEDTAVYYCARWGHSTSPWAMDYWGQGTLV TVSS |
| 800 | DVD711VL AB012VL | AB071VL | DIQMTQSPSSVSASVGDRVTITCRASQGISSWLAW YQQKPGKAPNLLIYEASSLQSGVPSRFGGSGSGTD FTLTISSLQPEDFATYYCQQANGFPWTFGQGTKVE IKRTVAAPDIQMTQSPSSLSASVGDRVTITCRASQ VIRRSLAWYQQKPGKAPKLLIYAASNLASGVPSRF SGSGSGTDFTLTISSLQPEDFATYYCQQSNTSPLT FGQGTKVEIKR |
| 801 | DVD712VH AB071VH | AB012VH | EVQLVESGGGLVQPGGSLRLSCAASGFTINASWIH WVRQARGKGLEWVGAIYPYSGYTNYADSVKGRFTI SADTSKNTAYLQMNSLRAEDTAVYYCARWGHSTSP WAMDYWGQGTLVTVSSASTKGPQVQLVESGGGLVK PGGSLRLSCAASGFTFSDYYMSWIRQAPGKGLEWV SYISSSGSTIYYADSVKGRFTISRDNAKNSLYLQM NSLRAEDTAVYYCARDEYNSGWYVLFDYWGQGTLV TVSS |
| 802 | DVD712VL AB071VL | AB012VL | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPDIQMIQSPSSVSASVGDRVTITCRASQ GISSWLAWYQQKPGKAPNLLIYEASSLQSGVPSRF GGSGSGTDFTLTISSLQPEDFATYYCQQANGFPWT FGQGTKVEIKR |

Example 2.177

Generation of HGF (Seq. 2) and VEGF (Seq. 1)
DVD-Igs with Linker Set 1

TABLE 211

| DVD SEQ ID NO | DVD Variable Domain Name | Outer Variable Domain Name | Inner Variable Domain Name | Sequence 123456789012345678901234567890123456789012345 |
|---|---|---|---|---|
| 803 | DVD659H | AB079VH | AB014VH | EVQLVQSGAEVKKPGESLKISCKGSGYSFTTYWMH WVRQMRGKGLEWMGEINPTNGHTNYNPSFQGQVTI SADKSISTAYLQWSSLKASDTAMYYCARNYVGSIF DYWGQGTLVTVSSASTKGPEVQLVESGGGLVQPGG SLRLSCAASGYTFTNYGMNWVRQAPGKGLEWVGWI NTYTGEPTYAADFKRRFTFSLDTSKSTAYLQMNSL RAEDTAVYYCAKYPHYYGSSHWYFDVWGQGTLVTV SS |
| 804 | DVD659L | AB079VL | AB014VL | DIQMTQSPSSLSASVGDRVTITCKASENVVSYVSW YQQKPGKAPKLLIYGASNRNTGVPSRFSGSGSGTD FTLTISSLQPEDFATYYCGQSYNYPYTFGQGTKLE IKRTVAAPDIQMTQSPSSLSASVGDRVTITCSASQ DISNYLNWYQQKPGKAPKVLIYFTSSLHSGVPSRF SGSGSGTDFTLTISSLQPEDFATYYCQQYSTVPWT FGQGTKVEIKR |
| 805 | DVD660H | AB014VH | AB07DVH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPEVQLVQSGAEV KKPGESLKISCKGSGYSFTTYWMHWVRQMPGKGLE WMGEINPTNGHTNYNPSFQGQVTISADKSISTAYL QWSSLKASDTAMYYCARNYVGSIFDYWGQGTLVTV SS |
| 806 | DVD660L | AB014VL | AB07DVL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSPSSLSASVGDRVTITCKASE NVVSYVSWYQQKPGKAPKLLIYGASNRNTGVPSRF SGSGSGTDFTLTISSLQPEDFATYYCGQSYNYPYT FGQGTKLEIKR |

Example 2.178

Generation of HGF (Seq. 2) and VEGF (Seq. 1)
DVD-Igs with Linker Set 2

TABLE 211

| DVD SEQ ID NO | DVD Variable Domain Name | Outer Variable Domain Name | Inner Variable Domain Name | Sequence 123456789012345678901234567890123456789012345 |
|---|---|---|---|---|
| 807 | DVD665H | AB079VH | AB014VH | EVQLVQSGAEVKKPGESLKISCKGSGYSFTTYWMH WVRQMRGKGLEWMGEINPTNGHTNYNPSFQGQVTI SADKSISTAYLQWSSLKASDTAMYYCARNYVGSIF DYWGQGTLVTVSSASTKGPSVFPLAPEVQLVESGG GLVQPGGSLRLSCAASGYTFTNYGMNWVRQAPGKG LEWVGWINTYTGEPTYAADFKRRFTFSLDTSKSTA YLQMNSLRAEDTAVYYCAKYPHYYGSSHWYFDVWG QGTLVTVSS |
| 808 | DVD665L | AB079VL | AB014VL | DIQMTQSPSSLSASVGDRVTITCKASENVVSYVSW YQQKPGKAPKLLIYGASNRNTGVPSRFSGSGSGTD FTLTISSLQPEDFATYYCGQSYNYPYTFGQGTKLE IKRTVAAPSVFIFPPDIQMTQSPSSLSASVGDRVT ITCSASQDISNYLNWYQQKPGKAPKVLIYFTSSLH SGVPSRFSGSGSGTDFTLTISSLQPEDFATYYCQQ YSTVPWTFGQGTKVEIKR |

TABLE 211-continued

| DVD SEQ ID NO | DVD Variable Domain Name | Outer Variable Domain Name | Inner Variable Domain Name | Sequence |
|---|---|---|---|---|
| 809 | DVD666H | AB014VH | AB079VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPEVQL VQSGAEVKKPGESLKISCKGSGYSFTTYWMHWVRQ MPGKGLEWMGEINPTNGHTNYNPSFQGQVTISADK SISTAYLQWSSLKASDTAMYYCARNYVGSIFDYWG QGTLVTVSS |
| 810 | DVD666L | AB014VL | AB079VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPSVFIFPPDIQMTQSPSSLSASVGDRVT ITCKASENVVSYVSWYQQKPGKAPKLLIYGASNRN TGVPSRFSGSGSGTDFTLTISSLQPEDFATYYCGQ SYNYPYTFGQGTKLEIKR |

Example 2.179

Generation of HGF (Seq. 2) and VEGF (Seq. 1) DVD-Igs with Linker Set 3

TABLE 213

| SEQ ID NO | DVD Variable Domain Name | Outer Variable Domain Name | Inner Variable Domain Name | Sequence |
|---|---|---|---|---|
| 811 | DVD671VH | AB079VH | AB014VH | EVQLVQSGAEVKKPGESLKISCKGSGYSFTTYWMH WVRQMPGKGLEWMGEINPTNGHTNYNPSFQGQVTI SADKSISTAYLQWSSLKASDTAMYYCARNYVGSIF DYWGQGTLVTVSSASTKGPSVFPLAPEVQLVESGG GLVQPGGSLRLSCAASGYTFTNYGMNWVRQAPGKG LEWVGWINTYTGEPTYAADFKRRFTFSLDTSKSTA YLQMNSLRAEDTAVYYCAKYPHYYGSSHWYFDVWG QGTLVTVSS |
| 812 | DVD671VL | AB079VL | AB014VL | DIQMTQSPSSLSAVSVGDRVTITCKASENVVSYVS WYQQKPGKAPKLLIYGASNRNTGVPSRFSGSGSGT DFTLTISSLQPEDFATYYCGQSYNYPYTFGQGTKL EIKRTVAAPDIQMTQSPSSLASASVGDRVTITCSA SQDISNYLNWYQQKPGKAPKVLIYFTSSLHSGVPS RFSGSGSGTDFTLTISSLQPEDFATYYCQQYSTVP WTFGQGTKVEIKR |
| 813 | DVD672VH | AB014VH | AB079VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPSVFPLAPEVQL VQSGAEVKKPGESLKISCKGSGYSFTTYWMHWVRQ MPGKGLEWMGEINPTNGHTNYNPSFQGQVTISADK SISTAYLQWSSLKASDTAMYYCARNYVGSIFDYWG QGTLVTVSS |
| 814 | DVD672VL | AB014VL | AB079VL | DIQMTQSPSSLSASVGDRVTITCSASQDISNYLNW YQQKPGKAPKVLIYFTSSLHSGVPSRFSGSGSGTD FTLTISSLQPEDFATYYCQQYSTVPWTFGQGTKVE IKRTVAAPDIQMTQSPSSLSASVGDRVTITCKASE NVVSYVSWYQQKPGKAPKLLIYGASNRNTGVPSRF SGSGSGTDFTLTISSLQPEDFATYYCGQSYNYPYT FGQGTKLEIKR |

Example 2.180

Generation of HGF (Seq. 2) and VEGF (Seq. 1) DVD-Igs with Linker Set 4

TABLE 214

| SEQ ID NO | DVD Variable Domain Name | Outer Variable Domain Name | Inner Variable Domain Name | Sequence 123456789012345678901234567890123 45 |
|---|---|---|---|---|
| 815 | DVD677VH | AB079VH | AB014VH | EVQLVQSGAEVKKPGESLKISCKGSGYSFTTYWMH WVRQMPGKGLEWMGEINPTNGHTNYNPSGQGQVTI SADKSISTAYLQWSSLKASDTAMYYCARNYVGSIF DYWGQGTLVTVSSASTKGPEVQLVESGGGLVQPGG SLRLSCAASGYTFTNYGMNWVRQAPGKGLEWVGWI NTYTGEPTYAADFKRRFTFSLDTSKSTAYLQMNSL RAEDTAVYYCAKYPHYYGSSHWYFDVWGQGTLVTV SS |
| 816 | DVD677VL | AB079VL | AB014VL | DIQMTSQPSSLSASVGDRVTITCKASENVVSYVSW YQQKPGKAPKLLIYGASNRNTGVPSRFSGSGSGTD FTLTISSLQPEDFATYYCGQSYNYPYTFGQGTKLE IKRTVAAPSVFIFPPDIQMTSQPSSLSASVGDRVT ITCSASQDISNYLNWYQQKPGKAPKVLIYFTSSLH SGVPSRFSGSGSGTDFTLTISSLQPEDFATYYCQQ YSTVPWTFGQGTKVEIKR |
| 817 | DVD678VH | AB014VH | AB079VH | EVQLVESGGGLVQPGGSLRLSCAASGYTFTNYGMN WVRQAPGKGLEWVGWINTYTGEPTYAADFKRRFTF SLDTSKSTAYLQMNSLRAEDTAVYYCAKYPHYYGS SHWYFDVWGQGTLVTVSSASTKGPEVQLVQSGAEV KKPGESLKISCKGSGYSFTTYWMHWVRQMPGKGLE WMGEINPTNGHTNYNPSFQGQVTISADKSISTAYL QWSSLKASDTAMYYCARNYVGSIFDYWGQGTLVTV SS |
| 818 | DVD678VL | AB014VL | AB079VL | DIQMTQSPSSLSASVGDRVTITCSASQDSINYLNW YQQKPGKAPKVLIYFTSSLHSGVPSRFSGSGSGTD FTLTISSLQPEDFATYYCQQYSTVPWTFGQGTKVE IKRTVAAPSVFIFPPDIQMTQSPSSLSASVGDRVT ITCKASENVVSYVSWYQQKPGKAPKLLIYGASNRN TGVPSRFSGSGSGTDFTLTISSLQPEDFATYYCGQ SYNYPYTFGQGTKLEIKR |

Example 2.181

Generation of HGF (Seq. 2) and VEGF (Seq. 2) DVD-Igs with Linker Set 1

TABLE 215

| SEQ ID NO | DVD Variable Domain Name | Outer Variable Domain Name | Inner Variable Domain Name | Sequence 123456789012345678901234567890123 45 |
|---|---|---|---|---|
| 819 | DVD661H | AB079VH | AB070VH | EVQLVQSGAEVKKPGESLKISCKGSGYSFTTYWMH WVRQMPGKGLEWMGEINPTNGHTNYNPSFQGQVTI SADKSISTAYLQWSSLKASDTAMYYCARNYVGSIF DYWGQGTLVTVSSASTKGPEVQLVESGGGLVQPGG SLRLSCAASGFTISDYWIHWVRQAPGKGLEWVAGI TPAGGYTYYADSVKGRFTISADTSKNTAYLQMNSL RAEDTAVYYCARFVFFLPYAMDYWGQGTLVTVSS |
| 820 | DVD661L | AB079VL | AB070VL | DIQMTQSPSSLSASVGDRVTITCKASENVVSYVSW YQQKPGKAPKLLIYGASNRNTGVPSRFSGSGSGTD FTLTISSLQPEDFATYYCGQSYNYPYTFGQGTKLE IKRTVAAPDIQMTQSPSSLSASVGDRVTITCRASQ DVSTAVAWYQQKPGKAPKLLIYSASFLYSGVPSRF SGSGSGTDFTLTISSLQPEDFATYYCQQSYTTPPT FGQGTKVEIKR |
| 821 | DVD662H | AB070VH | AB079VH | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPEVQLVQSGAEVKKP GESLKISCKGSGYSFTTYWMHWVRQMPGKGLEWMG EINPTNGHTNYNPSFQGQVTISADKSISTAYLQWS |

TABLE 215-continued

| SEQ ID NO | DVD Variable Domain Name | Outer Variable Domain Name | Inner Variable Domain Name | Sequence 123456789012345678901234567890012345 |
|---|---|---|---|---|
| | | | | SLKASDTAMYYCARNYVGSIFDYWGQGTLVTVSS |
| 822 | DVD662L | AB070VL | AB079VL | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPDIQMTQSPSSLSASVGDRVTITCKASE NVVSYNSWYQQKPGKAPKLLIYGASNRNTGVPSRF SGSGSGTDFTLTISSLQPEDFATYYCGQSYNYPYT FGQGTKLEIKR |

Example 2.182

Generation of HGF (Seq. 2) and VEGF (Seq. 2) DVD-Igs with Linker Set 2

TABLE 216

| SEQ ID NO | DVD Variable Domain Name | Outer Variable Domain Name | Inner Variable Domain Name | Sequence 123456789012345678901234567890012345 |
|---|---|---|---|---|
| 823 | DVD667H | AB079VH | AB070VH | EVQLVQSGAEVKKPGESLKISCKGSGYSFTTYWMH WVRQMPGKGLEWMGEINPTNGHTNYNPSFQGQVTI SADKSISTAYLQWSSLKASDTAMYYCARNYVGSIF DYWGQGTLVTVSSASTKGPSVFPLAPEVQLVESGG GLVQPGGSLRLSCAASGFTISDYWIHWVRQAPGKG LEWVAGITPAGGYTYYADSVKGRFTISADTSKNTA YLQMNSLRAEDTAVYYCARFVFFLPYAMDYWGQGT LVTVSS |
| 824 | DVD667L | AB079VL | AB070VL | DIQMTQSPSSLSASVGDRVTITCKASENVVSYVSW YQQKPGKAPKLLIYGASNRNTGVPSRFSGSGSGTD FTLTISSLQPEDFATYYCGQSYNYPYTFGQGTKLE IKRTVAAPSVFIFPPDIQMTQSPSSLSASVGDRVT ITCRASQDVSTAVAWYQQKPGKAPKLLIYSASFLY SGVPSRFSGSGSGTDFTLTISSLQPEDFATYYCQQ SYTTPPTFGQGTKVEIKR |
| 825 | DVD668H | AB070VH | AB079VH | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPEVQLVQS GAEVKKPGESLKISCKGSGYSFTTYWMHWVRQMPG KGLEWMGEINPTNGHTNYNPSFQGQVTISADKSIS TAYLQWSSLKASDTAMYYCARNYVGSIFDYWGQGT LVTVSS |
| 826 | DVD668L | AB070L | AB079VL | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPSVFIFPPDIQMTQSPSSLSASVGDRVT ITCKASENVVSYVSWYQQKPGKAPKLLIYGASNRN TGVPSRFSGSGSGTDFTLTISSLQPEDFATYYCGQ SYNYPYTFGQGTKLEIKR |

Example 2.183

Generation of HGF (Seq. 2) and VEGF (Seq. 2) DVD-Igs with Linker Set 3

TABLE 217

| SEQ ID NO | DVD Variable Domain Name | Outer Variable Domain Name | Inner Variable Domain Name | Sequence 123456789012345678901234567890012345 |
|---|---|---|---|---|
| 827 | DVD673VH | AB079VH | AB070VH | EVQLVQSGAEVKKPGESLKISCKGSGYSFTTYWMH WVRQMPGKGLEWMGEINPTNGHTNYNPSFQGQVTI SADKSISTAYLQWSSLKASDTAMYYCARNYVGSIF DYWGQGTLVTVSSASTKGPSVFPLAPEVQLVESGG GLVQPGGSLRLSCAASGFTISDYWIHWVRQAPGKG |

TABLE 217-continued

| SEQ ID NO | DVD Variable Domain Name | Outer Variable Domain Name | Inner Variable Domain Name | Sequence 123456789012345678901234567890123456789012345 |
|---|---|---|---|---|
|  |  |  |  | LEWVAGITPAGGYTYYADSVKGRFTISADTSKNTA YLQMNSLRAEDTAVYYCARFVFFLPYAMDYWGQGT LVTVSS |
| 828 | DVD673VL | AB079VL | AB070VL | DIQMTQSPSSLSASVGDRVTITCKASENVVSYVSW YQQKPGKAPKLLIYGASNRNTGVPSRFSGSGSGTD FTLTISSLQPEDFATYYCGQSYNYPYTFGQGTKLE IKRTVAAPDIQMTQSPSSLSASVGDRVTITCRASQ DVSTAVAWYQQKPGKAPKLLIYSASFLYSGVPSRF SGSGSGTDFTLTISSLQPEDFATYYCQQSYTTPPT FGQGTKVEIKR |
| 829 | DVD674VH | AB070VH | AB079VH | EVQLVESGGGLVQPGGSLRLSCAASGFTISDYWIH WRQAPGKGLEWVAGITPAGGYTYYADSVKGRFTI SADTSKNTAYLQMNSLRAEDTAVYYCARFVFFLPY AMDYWGQGTLVTVSSASTKGPSVFPLAPEVQLVQS GAEVKKPGESLKISCKGSGYSFTTYWMHWVRQMPG KGLEWMGEINPTNGHTNYNPSFQGQVTISADKSIS TAYLQWSSLKASDTAMYYCARNYVGSIFDYWGQGT LVTVSS |
| 830 | DVD674VL | AB070VL | AB079VL | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPDIQMTQSPSSLSASVGDRVTITCKASE NVVSYVSWYQQKPGKAPKLLIYGASNRNTGVPSRF SGSGSGTDFTLTISSLQPEDFATYYCGQSYNYPYT FGQGTKLEIKR |

Example 2.184

Generation of HGF (Seq. 2) and VEGF (Seq. 2) DVD-Igs with Linker Set 4

TABLE 218

| SEQ ID NO | DVD Variable Domain Name | Outer Variable Domain Name | Inner Variable Domain Name | Sequence 123456789012345678901234567890123456789012345 |
|---|---|---|---|---|
| 831 | DVD679VH | AB079VH | AB070VH | EVQLVQSGAEVKKPGESLKISCKGSGYSFTTYWMH WVRQMPGKGLEWMGEINPTNGHTNYNPSFQGQVTI SADKSISTAYLQWSSLKASDTAMYYCARNYVGSIF DYWGQGTLVTVSSASTKGPEVQLVESGGGLVQPGG SLRLSCAASGFTISDYWIHWVRQAPGKGLEWVAGI TPAGGYTYYADSVKGRFTISADTSKNTAYLQMNSL RAEDTAVYYCARFVFFLPYAMDYWGQGTLVTVSS |
| 832 | DVD679VL | AB079VL | AB070VL | DIQMTQSPSSLSASVGDRVTITCKASENVVSYVSW YQQKPGKAPKLLIYGASNRNTGVPSRFSGSGSGTD FTLTISSLQPEDFATYYCGQSYNYPYTFGQGTKLE IKRTVAAPSVFIFPPDIQMTQSPSSLSASVGDRVT ITCRASQDVSTAVAWYQQKPGKAPKLLIYSASFLY SGVPSRFSGSGSGTDFTLTISSLQPEDFATYYCQQ SYTTPPTFGQGTKVEIKR |
| 833 | DVD680VH | AB070VH | AB079VH | EVQLVESGGGLVQPGGSLRLSCAASGFTISDYWIH WVRQAPGKGLEWVAGITPAGGYTYYADSVKGRFTI SADTSKNTAYLQMNSLRAEDTAVYYCARDVFFLPY AMDYWGQGTLVTVSSASTKGPEVQLVQSGAEVKKP GESLKISCKGSGYSFTTYWMHWVRQMPGKGLEWMG EINPTNGHTNYNPSFQGQVTISADKSISTAYLQWS SLKASDTAMYYCARNYVGSIFDYWGQGTLVTVSS |
| 834 | DVD680VL | AB070VL | AB079VL | DIQMTQSPSSLSASVGDRVTITCRASQDVSTAVAW YQQKPGKAPKLLIYSASFLYSGVPSRFSGSGSGTD FTLTISSLQPEDFATYYCQQSYTTPPTFGQGTKVE IKRTVAAPSVFIFPPDIQMTQSPSSLSASVGDRVT ITCKASENVVSYVSWYQQKPGKAPKLLIYGASNRN TGVPSRFSGSGSGTDFTLTISSLQPEDFATYYCGQ SYNYPYTFGQGTKLEIKR |

Example 2.185

Generation of HGF (Seq. 2) and VEGF (Seq. 3) DVD-Igs with Linker Set 1

TABLE 219

| SEQ ID NO | DVD Variable Domain Name | Outer Variable Domain Name | Inner Variable Domain Name | Sequence 123456789012345678901234567890123456789012345 |
|---|---|---|---|---|
| 835 | DVD663H | AB079VH | AB071VH | EVQLVQSGAEVKKPGESLKISCKGSGYSFTTYWMH WVRQMPGKGLEWMGEINPTNGHTNYNPSFQGQVTI SADKSISTAYLQWSSLKASDTAMYYCARNYVGSIF DYWGQGTLVTVSSASTKGPEVQLVESGGGLVQPGG SLRLSCAASGFTINASWIHWVRQAPGKGLEWVGAI YPYSGYTNYADSVKGRFTISADTSKNTAYLQMNSL RAEDTAVYYCARWGHSTSPWAMDYWGQGTLVTVSS |
| 836 | DVD663L | AB079VL | AB071VL | DIQMTQSPSSLSASVGDRVTITCKASENVVSYVSW YQQKPGKAPKLLIYGASNRNTGVPSRFSGSGSGTD FTLTISSLQPEDFATYYCGQSYNYPYTFGQGTKLE IKRTVAAPDIQMTQSPSSLSASVGDRVTITCRASQ VIRRSLAWYQQKPGKAPKLLIYAASNLASGVPSRF SGSGSGTDFTLTISSLQPEDFATYYCQQSNTSPLT FGQGTKVEIKR |
| 837 | DVD664H | AB071VH | AB079VH | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPEVQLVQSGAEVKK PGESLKISCKGSGYSFTTYWMHWVRQMPGKGLEWM GEINPTNGHTNYNPSFQGQVTISADKSISTAYLQW SSLKASDTAMYYCARNYVGSIFDYWGQGTLVTVSS |
| 838 | DVD664L | AB071VL | AB079VL | DIQMTQSPSSLSASVGDRVTITCRASQVIRRSLAW YQQKPGKAPKLLIYAASNLASGVPSRFSGSGSGTD FTLTISSLQPEDFATYYCQQSNTSPLTFGQGTKVE IKRTVAAPDIQMTQSPSSLSASVGDRVTITCKASE NVVSYVSWYQQKPGKAPKLLIYGASNRNTGVPSRF SGSGSGTDFTLTISSLQPEDFATYYCGQSYNYPYT FGQGTKLEIKR |

Example 2.186

Generation of HGF (Seq. 2) and VEGF (Seq. 3) DVD-Igs with Linker Set 2

TABLE 220

| SEQ ID NO | DVD Variable Domain Name | Outer Variable Domain Name | Inner Variable Domain Name | Sequence 123456789012345678901234567890123456789012345 |
|---|---|---|---|---|
| 839 | DVD669H | AB079VH | AB071VH | EVQLVQSGAEVKKPGESLKISCKGSGYSFTTYWMH WVRQMPGKGLEWMGEINPTNGHTNYNPSFQGQVTI SADKSISTAYLQWSSLKASDTAMYYCARNYVGSIF DYWGQGTLVTVSSASTKGPSVFPLAPEVQLVESGG GLVQPGGSLRLSCAASGFTINASWIHWVRQAPGKG LEWVGAIYPYSGYTNYADSVKGRFTISADTSKNTA YLQMNSLRAEDTAVYYCARWGHSTSPWAMDYWGQG TLVTVSS |
| 840 | DVD669L | AB079VL | AB071VL | DIQMTQSPSSLSASVGDRVTITCKASENVVSYVSW YQQKPGKAPKLLIYGASNRNTGVPSRFSGSGSGTD FTLTISSLQPEDFATYYCGQSYNYPYTFGQGTKLE IKRTVAAPSVFIFPPDIQMTQSPSSLSASVGDRVT ITCRASQVIRRSLAWYQQKPGKAPKLLIYAASNLA SGVPSRFSGSGSGTDFTLTISSLQPEDFATYYCQQ SNTSPLTFGQGTKVEIKR |
| 841 | DVD670H | AB071VH | AB079VH | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPSVFPLAPEVQLVQ SGAEVKKPGESLKISCKGSGYSFTTYWMHWVRQMP GKGLEWMGEINPTNGHTNYNPSFQGQVTISADKSI |

TABLE 220-continued

| SEQ ID NO | DVD Variable Domain Name | Outer Variable Domain Name | Inner Variable Domain Name | Sequence 123456789012345678901234567890012345 |
|---|---|---|---|---|
| | | | | STAYLQWSSLKASDTAMYYCARNYVGSIFDYWGQGTLVTVSS |
| 842 | DVD670L | AB071VL | AB079VL | DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPDDIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKR |

Example 2.187

Generation of HGF (Seq. 2) and VEGF (Seq. 3) DVD-Igs with Linker Set 3

TABLE 221

| SEQ ID NO | DVD Variable Domain Name | Outer Variable Domain Name | Inner Variable Domain Name | Sequence 123456789012345678901234567890012345 |
|---|---|---|---|---|
| 843 | DVD675VH | AB079VH | AB071VH | EVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSSASTKGPSVFPLAPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS |
| 844 | DVD675VL | AB079VL | AB071VL | DIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKRTVAAPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR |
| 845 | DVD676VH | AB071VH | AB079VH | EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPEVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSS |
| 846 | DVD676VL | AB071VL | AB079VL | DIQMTQSPSSLSASVGDRVTITCRASWVIRRSLAWYQQKPGKAPKLLIYAASNLASGVPSRFSGSGSGTDFTLTISSLQPEDFATYYCQQSNTSPLTFGQGTKVEIKRTVAAPDIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKR |

Example 2.188

Generation of HGF (Seq. 2) and VEGF (Seq. 3) DVD-Igs with Linker Set 4

TABLE 222

| SEQ ID NO | DVD Variable Domain Name | Outer Variable Domain Name | Inner Variable Domain Name | Sequence 123456789012345678901234567890012345 |
|---|---|---|---|---|
| 847 | DVD681VH | AB079VH | AB071VH | EVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSSASTKGPEVQLVESGGGLVQPGG |

TABLE 222-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | SLRLSCAASGFTINASWIHWVRQAPGKGLEWVGAI YPYSGYTNYADSVKGRFTISADTSKNTAYLQMNSL RAEDTAVYYCARWGHSTSPWAMDYWGQGTLVTVSS |
| 848 | DVD681VL | AB079VL | AB071VL | DIQMTQSPSSLSASVGDRVTITCKASENVVSYVSW YQQKPGKAPKLLIYGASNRNTGVPSRFSGSGSGTD FTLTISSLQPEDFATYYCGQSYNYPYTFGQGTKLE IKRTVAAPSVFIFPPDIQMTQSPSSLSASVGDRVT ITVRASQVIRRSLAWYQQKPGKAPKLLIYAASNLA SGVPSRFSGSGSGTDFTLTISSLQPEDFATYYCQQ SNTSPLTFGQGTKVEIKR |
| 849 | DVD682VH | AB071VH | AB079VH | EVQLVESGGGLVQPGGSLRLSCAASGFTINASWIH WVRQAPGKGLEWVGAIYPYSGYTNYADSVKGRFTI SADTSKNTAYLQMNSLRAEDTAVYYCARWGHSTSP WAMDYWGQGTLVTVSSASTKGPEVQLVQSGAEVKK PGESLKISCKGSGYSFTTYWMHWVRQMPGKGLEWM GEINPTNGHTNYNPSFQGQVTISADKSISTAYLQW SSLKASDTAMYYCARNYVGSIFDYWGQGTLVTVSS |
| 850 | DVD682VL | AB071VL | AB079VL | DIQMTQSPSSLSASVGDRVTITCRASQVIRRSLAW YQQKPGKAPKLLIYAASNALSGVPSRFSGSGSGTD FTLTISSLQPEDFATYYCQQSNTSPLTFGQGTKVE IKRTVAAPSVFIFPPDIQMTQSPSSLSASVGDRVT ITCKASENVVSYVSWYQQKPGKAPKLLIYGASNRN TGVPSRFSGSGSGTDFTLTISSLQPEDFATYYCGQ SYNYPYTFGQGTKLEIKR |

Example 2.189

Generation of HER2 (Seq. 1) and HER2 (Seq. 2) DVD-Igs with Linker Set 1

TABLE 223

| SEQ ID NO | DVD Variable Domain Name | Outer Variable Domain Name | Inner Variable Domain Name | Sequence 123456789012345678901234567890123456789012345 |
|---|---|---|---|---|
| 851 | DVD687H | AB004VH | AB080VH | EVQLVESGGGLVQPGGSLRLSCAASGFNIDKTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPEVQLVESGGGLVQP GGSLRLSCAASGFTFTDYTMDWVRQAPGKGLEWVA DVNPNSGGSIYNQRFKGRFTLSVDRSKNTLYLQMN SLRAEDTAVYYCARNLGPSFYFDYWGQGTLVTVSS |
| 852 | DVD687L | AB004VL | AB080VL | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPFTGQGTKVE IKRTVAAPDIQMTQSPSSLSASVGDRVTITCKASQ DVSIGVAWYQQKPGKAPKLLIYSASYRYTGVPSRF SGSGSGTDFTLTISSLQPEDFATYYCQQYYIYPYT FGQGTKVEIKR |
| 853 | DVD688H | AB080VH | AB004VH | EVQLVESGGGLVQPGGSLRLSCAASGFTFTDYTMD WVRQAPGKGLEWVADVNPNSGGSIYNQRFKGRFTL SVDRSKNTLYLQMNSLRAEDTAVYYCARNLGPSFY FDYWGQGTLVTVSSASTKGPEVQLVESGGGLVQPG GSLRLSCAASGFNIKDTYIHWVRQAPGKGLEWVAR IYPTNGYTRYADSVKGRFTISADTSKNTAYLQMNS LRAEDTAVYYSCRWGGDGFYAMDYWGQGTLVTVSS |
| 854 | DVD688L | AB080VL | AB004VL | DIQMTQSPSSLSASVGDRVTITCKASQDVSIGVAW YQQKPGKAPKLLIYSASYRYTGVPSRFSGSGSGTD FTLTISSLQPEDFATYYCQQYYIYPYTFGQGTKVE IKRTVAAPDIQMTQSPSSLSASVGDRVTITCRASQ DVNTAVAWYQQKPGKAPKLLIYSASFLYSGVPSRF SGSRSGTDFTLTISSLQPEDFATYYCQQHYTTPPT FGQGTKVEIKR |

Example 2.190

Generation of HER2 (Seq. 1) and HER2 (Seq. 2)
DVD-Igs with Linker Set 2

TABLE 224

| SEQ ID NO | DVD Variable Domain Name | Outer Variable Domain Name | Inner Variable Domain Name | Sequence 123456789012345678901234567890112345 |
|---|---|---|---|---|
| 855 | DVD689H | AB004VH | AB080VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPSVFPLAPEVQLVES GGGLVQPGGSLRLSCAASGFTFTDYTMDWVRQAPG KGLEWVADVNPNSGGSIYNQRFKGRFTLSVDRSKN TLYLQMNSLRAEDTAVYYCARNLGPSFYFDYWGQG TLVTVSS |
| 856 | DVD689L | AB004VL | AB080VL | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPSVFIFPPDIQMTQSPSSLSASVGDRVT ITCKASQDVSIGVAWYQQKPGKAPKLLIYSASYRY TGVPSRFSGSGSGTDFTLTISSLQPEDFATYYCQQ YYIYPYTFGQGTKVEIKR |
| 857 | DVD690H | AB080VH | AB004VH | EVQLVESGGGLVQPGGSLRLSCAASGFTFTDYTMD WVRQAPGKGLEWVADVNPNSGGSIYNQRFKGRFTL SVDRSKNTLYLQMNSLRAEDTAVYYCARNLGPSFY FDYWGQGTLVTVSSASTKGPSVFPLAPEVQLVESG GGLVQPGGSLRLSCAASGFNIKDTYIHWVRQAPGK GLEWVARIYPTNGYTRYADSVKGRFTISADTSKNT AYLQMNSLRAEDTAVYYCSRWGGDGFYADMYWGQG TLVTVSS |
| 858 | DVD690L | AB080VL | AB004VL | DIQMTQSPSSLSASVGDRVTITCKASQDVSIGVAW YQQKPGKAPKLLIYSASYRYTGVPSRFSGSGSGTD FTLTISSLQPEDFATYYCQQYYIYPYTFGQGTKVE IKRTVAAPSVFIFPPDIQMTQSPSSLSASVGDRVT ITCRASQDVNTAVAWYQQKPGKAPKLLIYSASFLY SGVPSRFSGSGSGTDGTLTISSLQPEDFATYYCQQ HYTTPPTFGQGTKVEIKR |

Example 2.191

Generation of HER2 (Seq. 1) and HER2 (Seq. 2)
DVD-Igs with Linker Set 3

TABLE 225

| SEQ ID NO | DVD Variable Domain Name | Outer Variable Domain Name | Inner Variable Domain Name | Sequence 123456789012345678901234567890112345 |
|---|---|---|---|---|
| 859 | DVD691H | AB004VH | AB080VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPSVFPLAPEVQLVES GGGLVQPGGSLRLSCAASGFTFTDYTMDWVRQAPG KGLEWVADVNPNSGGSIYNQRFKGRFTLSVDRSKN TLYLQMNSLRAEDTAVYYCARNLGPSFYFDYWGQG TLVTVSS |
| 860 | DVD691L | AB004VL | AB080VL | DIQMTQSPSSLSASVGDRVTITCRASQDVNTAVAW YQQKPGKAPKLLIYSASFLYSGVPSRFSGSGSGTD FTLTISSLQPEDFATYYCQQHYTTPPTFGQGTKVE IKRTVAAPDIQMTQSPSSLSASVGDRVTITCKASQ DVSIGVAWYQQKPGKAPKLLIYSASYRYTGVPSRF SGSGSGTDFTLTISSLQPEDFATYYCQQYYIYPYT FGQGTKVEIKR |
| 861 | DVD692H | AB080VH | AB004VH | EVQLVESGGGLVQPGGSLRLSCAASGFTFTDYTMD WVRQAPGKGLEWVADVNPNSGGSIYNQRFKGRFTL SVDRSKNTLYLQMNSLRAEDTAVYYCARNLGPSFY FDYWGQGTLVTVSSASTKGPSVFPLAPEVQLVESG GGLVQPGGSLRLSCAASGFNIKDTYIHWVRQAPGK |

TABLE 225-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | GLEWVARIYPTNGYTRYADSVKGRFTISADTSKNT AYLQMNSLRAEDTAVYYCSRWGGDGFYAMDYWGQG TLVTVSS |
| 862 | DVD692L | AB080VL | AB004VL | DIQMTQSPSSLSASVGDRVTITCKASQDVSIGVAW YQQKPGKAPKLLIYSASYRYTGVPSRFSGSGSGTD FTLTISSLQPEDFATYYCQQYYIYPYTFGQGTKVE IKRTVAAPDIQMTQSPSSLSASVGDRVTITCRASQ DVNTAVAWYQQKPGKAPKLLIYSASFLYSGVPSRF SGSRSGTDFTLTISSLQPEDFATYYCQQHYTTPPT FGQGTKVEIKR |

Example 2.192

Generation of HER2 (Seq. 1) and HER2 (Seq. 2) DVD-Igs with Linker Set 4

TABLE 226

| SEQ ID NO | DVD Variable Domain Name | Outer Variable Domain Name | Inner Variable Domain Name | Sequence 123456789012345678901234567890123456789012345 |
|---|---|---|---|---|
| 863 | DVD693H | AB004VH | AB080VH | EVQLVESGGGLVQPGGSLRLSCAASGFNIKDTYIH WVRQAPGKGLEWVARIYPTNGYTRYADSVKGRFTI SADTSKNTAYLQMNSLRAEDTAVYYCSRWGGDGFY AMDYWGQGTLVTVSSASTKGPEVQLVESGGGLVQP GGSLRLSCAASGFTFTDYTMDWVRQAPGKGLEWVA DVNPNSGGSIYNQRFKGRFTLSVDRSKNTLYLQMN SLRAEDTAVYYCARNLGPSFYFDYWGQGTLVTVSS |
| 864 | DVD693L | AB004VL | AB080VL | DIQMTQSPSSLSASVGDRVTITCRASQDVNTAVAW YQQKPGKAPKLLIYSASFLYSGVPSRFSGSRSGTD FTLTISSLQPEDFATYYCQQHYTTPPTFGQGTKVE IKRTVAAPSVFIFPPDIQMTQSPSSLSASVGDRVT ITCKASQDVSIGVAWYQQKPGKAPKLLIYSASYRY TGVPSRFSGSGSGTDFTLTISSLQPEDFATYYCQQ YYIYPYTFGQGTKVEIKR |
| 865 | DVD694H | AB080VH | AB004VH | EVQLVESGGGLVQPGGSLRLSCAASGFTFTDYTMD WVRQAPGKGLEWVADVNPNSGGSIYNQRFKGRFTL SVDRSKNTLYLQMNSLRAEDTAVYYCARNLGPSFY FDYWGQGTLVTVSSASTKGPEVQLVESGGGLVQPG GSLRLSCAASGFNIKDTYIHWVRQAPGKGLEWVAR IYPTNGYTRYADSVKGRFTISADTSKNTAYLQMNS LRAEDTAVYYCSRWGGDGFYAMDYWGQGTLVTVSS |
| 866 | DVD694L | AB080VL | AB004VL | DIQMTQSPSSLSASVGDRVTITCKASQDVSIGVAW YQQKPGKAPKLLIYSASYRYTGVPSRFSGSGSGTD FTLTISSLQPEDFATYYCQQYYIYPYTFGQGTKVE IKRTVAAPSVFIFPPDIQMTQSPSSLSASVGDRVT ITCRASQDVNTAVAWYQQKPGKAPKLLQYSASFLY SGVPSRFSGSRSGTDFTLTISSLQPEDFATYYCQQ HYTTPPTFGQGTKVEIKR |

Example 2.193

Cloning Vector Sequences Used to Clone Parent Antibody and DVD-Ig Sequences

TABLE 226

| Vector name | SEQ ID NO | Nucleotide sequences 1234567890123456789012345678901234567890123456789012345678901 |
|---|---|---|
| V1 | 867 | GCGTCGACCAAGGGCCCATCGGTCTTCCCCCTGGCACCCTCCTCCAAGAGC ACCTCTGGGGGCACAGCGGCCCTGGGCTGCCTGGTCAAGGACTACTTCCCC GAACCGGTGACGGTGTCGTGGAACTCAGGCGCCCTGACCAGCGGCGTGCAC ACCTTCCCGGCTGTCCTACAGTCCTCAGGACTCTACTCCCTCAGCAGCGTG GTGACCGTGCCCTCCAGCAGCTTGGGCACCCAGACCTACATCTGCAACGTG |

TABLE 226-continued

| Vector name | SEQ ID NO | Nucleotide sequences |
|---|---|---|
| | | AATCACAAGCCCAGCAACACCAAGGTGGACAAGAAAGTTGAGCCCAAATCT
TGTGACAAAACTCACACATGCCCACCGTGCCCAGCACCTGAACTCCTGGGG
GGACCGTCAGTCTTCCTCTTCCCCCCAAAACCCAAGGACACCCTCATGATC
TCCCGGACCCCTGAGGTCACATGCGTGGTGGTGGACGTGAGCCACGAAGAC
CCTGAGGTCAAGTTCAACTGGTACGTGGACGGCGTGGAGGTGCATAATGCC
AAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGC
AAGGTCTCCAACAAAGCCCTCCCAGCCCCCATCGAGAAAACCATCTCCAAA
GCCAAAGGGCAGCCCCGAGAACCACAGGTGTACACCCTGCCCCCATCCCGC
GAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAAC
AACTACAAGACCACGCCTCCCGTGCTGGACTCCGACGGCTCCTTCTTCCTC
TACAGCAAGCTCACCGTGGACAAGAGCAGGTGGCAGCAGGGGAACGTCTTC
TCATGCTCCGTGATGCATGAGGCTCTGCACAACCACTACACGCAGAAGAGC
CTCTCCCTGTCTCCGGGTAAATGAGCGGCCGCTCGAGGCCGGCAAGGCCGG
ATCCCCCGACCTCGACCTCTGGCTAATAAAGGAAATTTATTTTCATTGCAA
TAGTGTGTTGGAATTTTTTGTGTCTCTCACTCGGAAGGACATATGGGAGGG
CAAATCATTTGGTCGAGATCCCTCGGAGATCTCTAGCTAGAGGATCGATCC
CCGCCCCGGACGAACTAAACCTGACTACGACATCTCTGCCCCTTCTTCGCG
GGGCAGTGCATGTAATCCCTTCAGTTGGTTGGTACAACTTGCCAACTGGGC
CCTGTTCCACATGTGACACGGGGGGGACCAAACACAAGGGGTTCTCTGA
CTGTAGTTGACATCCTTATAAATGGATGTGCACATTTGCCAACACTGAGTG
GCTTTCATCCTGGAGCAGATTTGCAGTCTGTGGACTGCAACACAACATTG
CCTTTATGTGTAACTCTTGGCTGAAGCTCTTACACCAATGCTGGGGGACAT
GTACCTCCCAGGGGCCCAGGAAGACTACGGGAGGCTACACCAACGTCAATC
AGAGGGGCCTGTGTAGCTACCGATAAGCGGACCCTCAAGAGGGCATTAGCA
ATAGTGTTTATAAGGCCCCCTTGTTAACCCTAAACGGGTAGCATATGCTTC
CCGGGTAGTAGTATATACTATCCAGACTAACCCTAATTCAATAGCATATGT
TACCCAACGGGAAGCATATGCTATCGAATTAGGGTTAGTAAAAGGGTCCTA
AGGAACAGCGATATCTCCCACCCCATGAGCTGTCACGGTTTTATTTACATG
GGGTCAGGATTCCACGAGGGTAGTGAACCATTTTAGTCACAAGGGCAGTGG
CTGAAGATCAAGGAGCGGGCAGTGAACTCTCCTGAATCTTCGCCTGCTTCT
TCATTCTCCTTCGTTTAGCTAATAGAATAACTGCTGAGTTGTGAACAGTAA
GGTGTATGTGAGGTGCTCGAAAACAAGGTTTCAGGTGACGCCCCCAGAATA
AAATTTGGACGGGGGGTTCAGTGGTGGCATTGTGCTATGACACCAATATAA
CCCTCACAAACCCCTTGGGCAATAAATACTAGTGTAGGAATGAAACATTCT
GAATATCTTTAACAATAGAAATCCATGGGTGGGGACAAGCCGTAAAGACT
GGATGTCCATCTCACACGAATTTATGGCTATGGGCAACACATAATCCTAGT
GCAATATGATACTGGGGTTATTAAGATGTGTCCCAGGCAGGGACCAAGACA
GGTGAACCATGTTGTTACACTCTATTTGTAACAAGGGGAAAGAGAGTGGAC
GCCGACAGCAGCGGACTCCACTGGTTGTCTCTAACACCCCCGAAAATTAAA
CGGGGGCTCCACGCCAATGGGGCCCATAAACAAAGACAAGTGGCCACTCTTT
TTTTTGAAATTGTGGAGTGGGGGCACGCGTCAGCCCCCACACGCCGCCCTG
CGGTTTTGGACTGTAAAATAAGGGTGTAATAACTTGGCTGATTGTAACCCC
GCTAACCACTGCGGTCAAACCACTTGCCCACAAAACCACTAATGGCACCCC
GGGGAATACCTGCATAAGTAGGTGGGCGGGCCAAGATAGGGGCGCGATTGC
TGCGATCTGGAGGACAAATTACACACACTTGCGCCTGAGCGCCAAGCACAG
GGTTGTTGGTCCTCATATTCACGAGGTCGCTGAGAGCACGGTGGGCTAATG
TTGCCATGGGTAGCATATACTACCCAAATATCTGGATAGCATATGCTATCC
TAATCTATATCTGGGTAGCATAGGCTATCCTAATCTATATCTGGGTAGCAT
ATGCTATCCTAATCTATATCTGGGTAGTATATGCTATCCTAATTTATATCT
GGGTAGCATAGGCTATCCTAATCTATATCTGGGTAGCATATGCTATCCTAA
TCTATATCTGGGTAGTATATGCTATCCTAATCTGTATCCGGGTAGCATATG
CTATCCTAATAGAGATTAGGGTAGTATATGCTATCCTAATTTATATCTGGG
TAGCATATACTACCCAAATATCTGGATAGCATATGCTATCCTAATCTATAT
CTGGGTAGCATATGCTATCCTAATCTATATCTGGGTAGCATAGGCTATCCT
AATCTATATCTGGGTAGCATATGCTATCCTAATCTATATCTGGGTAGTATA
TGCTATCCTAATTTATATCTGGGTAGCATAGGCTATCCTAATCTATATCTG
GGTAGCATATGCTATCCTAATCTATATCTGGGTAGTATATGCTATCCTAAT
CTGTATCCGGGTAGCATATGCTATCCTCATGATAAGCTGTCAAACATGAGA
ATTTTCTTGAAGACGAAAGGGCCTCGTGATACGCCTATTTTTATAGGTTAA
TGTCATGATAATAATGGTTTCTTAGACGTCAGGTGGCACTTTTCGGGGAAA
TGTGCGCGGAACCCCTATTTGTTTATTTTTCTAAATACATTCAAATATGTA
TCCGCTCATGAGACAATAACCCTGATAAATGCTTCAATAATATTGAAAAAG
GAAGAGTATGAGTATTCAACATTTCCGTGTCGCCCTTATTCCCTTTTTTGC
GGCATTTTGCCTTCCTGTTTTTGCTCACCCAGAAACGCTGGTGAAAGTAAA
AGATGCTGAAGATCAGTTGGGTGCACGAGTGGGTTACATCGAACTGGATCT
CAACAGCGGTAAGATCCTTGAGAGTTTTCGCCCCGAAGAACGTTTTCCAAT
GATGAGCACTTTTAAAGTTCTGCTATGTGGCGCGGTATTATCCCGTGTTGA
CGCCGGGCAAGAGCAACTCGGTCGCCGCATACACTATTCTCAGAATGACTT
GGTTGAGTACTCACCAGTCACAGAAAAGCATCTTACGGATGGCATGACAGT
AAGAGAATTATGCAGTGCTGCCATAACCATGAGTGATAACACTGCGGCCAA
CTTACTTCTGACAACGATCGGAGGACCGAAGGAGCTAACCGCTTTTTTGCA
CAACATGGGGATCATGTAACTCGCCTTGATCGTTGGGAACCGGAGCTGAA
TGAAGCCATACCAAACGACGAGCGTGACACCACGATGCCTGCAGCAATGGC
AACAACGTTGCGCAAACTATTAACTGGCGAACTACTTACTCTAGCTTCCCG
GCAACAATTAATAGACTGGATGGAGGCGGATAAAGTTGCAGGACCACTTCT |

TABLE 226-continued

| Vector name | SEQ ID NO | Nucleotide sequences |
|---|---|---|
| | | GCGCTCGGCCCTTCCGGCTGGCTGGTTTATTGCTGATAAATCTGGAGCCGG |
| | | TGAGCGTGGGTCTCGCGGTATCATTGCAGCACTGGGGCCAGATGGTAAGCC |
| | | CTCCCGTATCGTAGTTATCTACACGACGGGGAGTCAGGCAACTATGGATGA |
| | | ACGAAATAGACAGATCGCTGAGATAGGTGCCTCACTGATTAAGCATTGGTA |
| | | ACTGTCAGACCAAGTTTACTCATATATACTTTAGATTGATTTAAAACTTCA |
| | | TTTTTAATTTAAAAGGATCTAGGTGAAGATCCTTTTTGATAATCTCATGAC |
| | | CAAAATCCCTTAACGTGAGTTTTCGTTCCACTGAGCGTCAGACCCCGTAGA |
| | | AAAGATCAAAGGATCTTCTTGAGATCCTTTTTTTCTGCGCGTAATCTGCTG |
| | | CTTGCAAACAAAAAAACCACCGCTACCAGCGGTGGTTTGTTTGCCGGATCA |
| | | AGAGCTACCAACTCTTTTTCCGAAGGTAACTGGCTTCAGCAGAGCGCAGAT |
| | | ACCAAATACTGTTCTTCTAGTGTAGCCGTAGTTAGGCCACCACTTCAAGAA |
| | | CTCTGTAGCACCGCCTACATACCTCGCTCTGCTAATCCTGTTACCAGTGGC |
| | | TGCTGCCAGTGGCGATAAGTCGTGTCTTACCGGGTTGGACTCAAGACGATA |
| | | GTTACCGGATAAGGCGCAGCGGTCGGGCTGAACGGGGGGTTCGTGCACACA |
| | | GCCCAGCTTGGAGCGAACGACCTACACCGAACTGAGATACCTACAGCGTGA |
| | | GCTATGAGAAAGCGCCACGCTTCCCGAAGGGAGAAAGGCGGACAGGTATCC |
| | | GGTAAGCGGCAGGGTCGGAACAGGAGAGCGCACGAGGGAGCTTCCAGGGGG |
| | | AAACGCCTGGTATCTTTATAGTCCTGTCGGGTTTCGCCACCTCTGACTTGA |
| | | GCGTCGATTTTTGTGATGCTCGTCAGGGGGCGGAGCCTATGGAAAAACGC |
| | | CAGCAACGCGGCCTTTTTACGGTTCCTGGCCTTTTGCTGGCCTTTTGCTCA |
| | | CATGTTCTTTCCTGCGTTATCCCCTGATTCTGTGGATAACCGTATTACCGC |
| | | CTTTGAGTGAGCTGATACCGCTCGCCGCAGCCGAACGACCGAGCGCAGCGA |
| | | GTCAGTGAGCGAGGAAGCGGAAGAGCGCCCAATACGCAAACCGCCTCTCCC |
| | | CGCGCGTTGGCCGATTCATTAATGCAGCTGGCACGACAGGTTTCCCGACTG |
| | | GAAAGCGGGCAGTGAGCGCAACGCAATTAATGTGAGTTAGCTCACTCATTA |
| | | GGCACCCCAGGCTTTACACTTTATGCTTCCGGCTCGTATGTTGTGTGGAAT |
| | | TGTGAGCGGATAACAATTTCACACAGGAAACAGCTATGACCATGATTACGC |
| | | CAAGCTCTAGCTAGAGGTCGAGTCCCTCCCAGCAGGCAGAAGTATGCAAA |
| | | GCATGCATCTCAATTAGTCAGCAACCATAGTCCCGCCCCTAACTCCGCCCA |
| | | TCCCGCCCCTAACTCCGCCCAGTTCCGCCCATTCTCCGCCCCATGGCTGAC |
| | | TAATTTTTTTTATTTATGCAGAGGCCGAGGCCGCCTCGGCCTCTGAGCTAT |
| | | TCCAGAAGTAGTGAGGAGGCTTTTTTGGAGGCCTAGGCTTTTGCAAAAAGC |
| | | TTTGCAAAGATGGATAAAGTTTTAAACAGAGAGGAATCTTTGCAGCTAATG |
| | | GACCTTCTAGGTCTTGAAAGGAGTGGGAATTGGCTCCGGTGCCCGTCAGTG |
| | | GGCAGAGCGCACATCGCCCACAGTCCCCGAGAAGTTGGGGGGAGGGGTCGG |
| | | CAATTGAACCGGTGCCTAGAGAAGGTGGCGCGGGGTAAACTGGGAAAGTGA |
| | | TGTCGTGTACTGGCTCCGCCTTTTTCCCGAGGGTGGGGGAGAACCGTATAT |
| | | AAGTGCAGTAGTCGCCGTGAACGTTCTTTTTCGCAACGGGTTTGCCGCCAG |
| | | AACACAGGTAAGTGCCGTGTGTGGTTCCCGCGGGCCTGGCCTCTTTACGGG |
| | | TTATGGCCCTTGCGTGCCTTGAATTACTTCCACCTGGCTGCAGTACGTGAT |
| | | TCTTGATCCCGAGCTTCGGGTTGGAAGTGGGTGGGAGAGTTCGAGGCCTTG |
| | | CGCTTAAGGAGCCCCTTCGCCTCGTGCTTGAGTTGAGGCCTGGCCTGGGCG |
| | | CTGGGGCCGCCGCGTGCGAATCTGGTGGCACCTTCGCGCCTGTCTCGCTGC |
| | | TTTCGATAAGTCTCTAGCCATTTAAAATTTTTGATGACCTGCTGCGACGCT |
| | | TTTTTTCTGGCAAGATAGTCTTGTAAATGCGGGCCAAGATCTGCACACTGG |
| | | TATTTCGGTTTTTGGGGCCGCGGGCGGCGACGGGGCCCGTGCGTCCCAGCG |
| | | CACATGTTCGGCGAGGCGGGGCCTGCGAGCGCGGCCACCGAGAATCGGACG |
| | | GGGGTAGTCTCAAGCTGGCCGGCCTGCTCTGGTGCCTGGCCTCGCGCCGCC |
| | | GTGTATCGCCCCGCCCTGGGCGGCAAGGCTGGCCCGGTCGGCACCAGTTGC |
| | | GTGAGCGGAAAGATGGCCGCTTCCCGGCCCTGCTGCAGGGAGCTCAAAATG |
| | | GAGGACGCGGCGCTCGGGAGAGCGGGCGGGTGAGTCACCCACACAAAGGAA |
| | | AAGGGCCTTTCCGTCCTCAGCCGTCGCTTCATGTGACTCCACGGAGTACCG |
| | | GGCGCCGTCCAGGCACCTCGATTAGTTCTCGAGCTTTTGGAGTACGTCGTC |
| | | TTTAGGTTGGGGGGAGGGGTTTTATGCGATGGAGTTTCCCCACACTGAGTG |
| | | GGTGGAGACTGAAGTTAGGCCAGCTTGGCACTTGATGTAATTCTCCTTGGA |
| | | ATTTGCCCTTTTTGAGTTTGGATCTTGGTTCATTCTCAAGCCTCAGACAGT |
| | | GGTTCAAAGTTTTTTTCTTCCATTTCAGGTGTCGTGAGGAATTCTCTAGAG |
| | | ATCCCTCGACCTCGAGATCCATTGTGCCCGGGCGCCACCATGGAGTTTGGG |
| | | CTGAGCTGGCTTTTTCTTGTCGCGATTTTAAAAGGTGTCCAGTGC |
| V2 | 868 | ACGGTGGCTGCACCATCTGTCTTCATCTTCCCGCCATCTGATGAGCAGTTG |
| | | AAATCTGGAACTGCCTCTGTTGTGTGCCTGCTGAATAACTTCTATCCCAGA |
| | | GAGGCCAAAGTACAGTGGAAGGTGGATAACGCCCTCCAATCGGGTAACTCC |
| | | CAGGAGAGTGTCACAGAGCAGGACAGCAAGGACAGCACCTACAGCCTCAGC |
| | | AGCACCCTGACGCTGAGCAAAGCAGACTACGAGAAACACAAAGTCTACGCC |
| | | TGCGAAGTCACCCATCAGGGCCTGAGCTCGCCCGTCACAAAGAGCTTCAAC |
| | | AGGGGAGAGTGTTGAGCGGCCGCTCGAGGCCGGCAAGGCCGGATCCCCCGA |
| | | CCTCGACCTCTGGCTAATAAAGGAAATTTATTTTCATTGCAATAGTGTGTT |
| | | GGAATTTTTTGTGTCTCTCACTCGGAAGGACATATGGGAGGGCAAATCATT |
| | | TGGTCGAGATCCCTCGGAGATCTCTAGCTAGAGGATCGATCCCCGCCCCGG |
| | | ACGAACTAAACCTGACTACGACATCTCTGCCCCTTCTTCGCGGGGCAGTGC |
| | | ATGTAATCCCTTCAGTTGGTTGGTACAACTTGCCAACTGGGCCCTGTTCCA |
| | | CATGTGACACGGGGGGGGACCAAACACAAAGGGGTTCTCTGACTGTAGTTG |
| | | ACATCCTTATAAATGGATGTGCACATTTGCCAACACTGAGTGGCTTTCATC |
| | | CTGGAGCAGACTTTGCAGTCTGTGGACTGCAACACAACATTGCCTTTATGT |
| | | GTAACTCTTGGCTGAAGCTCTTACACCAATGCTGGGGGACATGTACCTCCC |
| | | AGGGGCCCAGGAAGACTACGGGAGGCTACACCAACGTCAATCAGAGGGGCC |

TABLE 226-continued

| Vector name | SEQ ID NO | Nucleotide sequences 12345678901234567890123456789012345678901234567890 1 |
|---|---|---|
| | | TGTGTAGCTACCGATAAGCGGACCCTCAAGAGGGCATTAGCAATAGTGTTT |
| | | ATAAGGCCCCTTGTTAACCCTAAACGGGTAGCATATGCTTCCCGGGTAGT |
| | | AGTATATACTATCCAGACTAACCCTAATTCAATAGCATATGTTACCCAACG |
| | | GGAAGCATATGCTATCGAATTAGGGTTAGTAAAAGGGTCCTAAGGAACAGC |
| | | GATATCTCCCACCCCATGAGCTGTCACGGTTTTATTTACATGGGGTCAGGA |
| | | TTCCACGAGGGTAGTGAACCATTTTAGTCACAAGGGCAGTGGCTGAAGATC |
| | | AAGGAGCGGGCAGTGAACTCTCCTGAATCTTCGCCTGCTTCTTCATTCTCC |
| | | TTCGTTTAGCTAATAGAATAACTGCTGAGTTGTGAACAGTAAGGTGTATGT |
| | | GAGGTGCTCGAAAACAAGGTTTCAGGTGACGCCCCAGAATAAAATTTGGA |
| | | CGGGGGGTTCAGTGGTGGCATTGTGCTATGACACCAATATAACCCTCACAA |
| | | ACCCCTTGGGCAATAAATACTAGTGTAGGAATGAAACATTCTGAATATCTT |
| | | TAACAATAGAAATCCATGGGTGGGGACAAGCCGTAAAGACTGGATGTCCA |
| | | TCTCACACGAATTTATGGCTATGGGCAACACATAATCCTAGTGCAATATGA |
| | | TACTGGGGTTATTAAGATGTGTCCCAGGCAGGGACCAAGACAGGTGAACCA |
| | | TGTTGTTACACTCTATTTGTAACAAGGGGAAAGAGAGTGGACGCCGACAGC |
| | | AGCGGACTCCACTGGTTGTCTCTAACACCCCCGAAAATTAAACGGGGCTCC |
| | | ACGCCAATGGGGCCCATAAACAAAGACAAGTGGCCACTCTTTTTTTTGAAA |
| | | TTGTGGAGTGGGGGCACGCGTCAGCCCCCACACGCCGCCCTGCGGTTTTGG |
| | | ACTGTAAAATAAGGGTGTAATAACTTGGCTGATTGTAACCCCGCTAACCAC |
| | | TGCGGTCAAACCACTTGCCCACAAAACCACTAATGGCACCCCGGGGAATAC |
| | | CTGCATAAGTAGGTGGGCGGGCCAAGATAGGGGCGCGATTGCTGCGATCTG |
| | | GAGGACAAATTACACACACTTGCGCCTGAGCGCCAAGCACAGGGTTGTTGG |
| | | TCCTCATATTCACGAGGTCGCTGAGAGCACGGTGGGCTAATGTTGCCATGG |
| | | GTAGCATATACTACCCAAATATCTGGATAGCATATGCTATCCTAATCTATA |
| | | TCTGGGTAGCATAGGCTATCCTAATCTATATCTGGGTAGCATATGCTATCC |
| | | TAATCTATATCTGGGTAGTATATGCTATCCTAATTTATATCTGGGTAGCAT |
| | | AGGCTATCCTAATCTATATCTGGGTAGCATATGCTATCCTAATCTATATCT |
| | | GGGTAGTATATGCTATCCTAATCTGTATCCGGGTAGCATATGCTATCCTAA |
| | | TAGAGATTAGGGTAGTATATGCTATCCTAATTTATATCTGGGTAGCATATA |
| | | CTACCCAAATATCTGGATAGCATATGCTATCCTAATCTATATCTGGGTAGC |
| | | ATATGCTATCCTAATCTATATCTGGGTAGCATAGGCTATCCTAATCTATAT |
| | | CTGGGTAGCATATGCTATCCTAATCTATATCTGGGTAGTATATGCTATCCT |
| | | AATTTATATCTGGGTAGCATAGGCTATCCTAATCTATATCTGGGTAGCATA |
| | | TGCTATCCTAATCTATATCTGGGTAGTATATGCTATCCTAATCTGTATCCG |
| | | GGTAGCATATGCTATCCTCATGATAAGCTGTCAAACATGAGAATTTTCTTG |
| | | AAGACGAAAGGGCCTCGTGATACGCCTATTTTTATAGGTTAATGTCATGAT |
| | | AATAATGGTTTCTTAGACGTCAGGTGGCACTTTTCGGGGAAATGTGCGCGG |
| | | AACCCCTATTTGTTTATTTTTCTAAATACATTCAAATATGTATCCGCTCAT |
| | | GAGACAATAACCCTGATAAATGCTTCAATAATATTGAAAAAGGAAGAGTAT |
| | | GAGTATTCAACATTTCCGTGTCGCCCTTATTCCCTTTTTTGCGGCATTTTG |
| | | CCTTCCTGTTTTTGCTCACCCAGAAACGCTGGTGAAAGTAAAAGATGCTGA |
| | | AGATCAGTTGGGTGCACGAGTGGGTTACATCGAACTGGATCTCAACAGCGG |
| | | TAAGATCCTTGAGAGTTTTCGCCCCGAAGAACGTTTTCCAATGATGAGCAC |
| | | TTTTAAAGTTCTGCTATGTGGCGCGGTATTATCCCGTGTTGACGCCGGGCA |
| | | AGAGCAACTCGGTCGCCGCATACACTATTCTCAGAATGACTTGGTTGAGTA |
| | | CTCACCAGTCACAGAAAAGCATCTTACGGATGGCATGACAGTAAGAGAATT |
| | | ATGCAGTGCTGCCATAACCATGAGTGATAACACTGCGGCCAACTTACTTCT |
| | | GACAACGATCGGAGGACCGAAGGAGCTAACCGCTTTTTTGCACAACATGGG |
| | | GGATCATGTAACTCGCCTTGATCGTTGGGAACCGGAGCTGAATGAAGCCAT |
| | | ACCAAACGACGAGCGTGACACCACGATGCCTGCAGCAATGGCAACAACGTT |
| | | GCGCAAACTATTAACTGGCGAACTACTTACTCTAGCTTCCCGGCAACAATT |
| | | AATAGACTGGATGGAGGCGGATAAAGTTGCAGGACCACTTCTGCGCTCGGC |
| | | CCTTCCGGCTGGCTGGTTTATTGCTGATAAATCTGGAGCCGGTGAGCGTGG |
| | | GTCTCGCGGTATCATTGCAGCACTGGGGCCAGATGGTAAGCCCTCCCGTAT |
| | | CGTAGTTATCTACACGACGGGGAGTCAGGCAACTATGGATGAACGAAATAG |
| | | ACAGATCGCTGAGATAGGTGCCTCACTGATTAAGCATTGGTAACTGTCAGA |
| | | CCAAGTTTACTCATATATACTTTAGATTGATTTAAAACTTCATTTTTAATT |
| | | TAAAAGGATCTAGGTGAAGATCCTTTTTGATAATCTCATGACCAAAATCCC |
| | | TTAACGTGAGTTTTCGTTCCACTGAGCGTCAGACCCCGTAGAAAAGATCAA |
| | | AGGATCTTCTTGAGATCCTTTTTTTCTGCGCGTAATCTGCTGCTTGCAAAC |
| | | AAAAAAACCACCGCTACCAGCGGTGGTTTGTTTGCCGGATCAAGAGCTACC |
| | | AACTCTTTTTCCGAAGGTAACTGGCTTCAGCAGAGCGCAGATACCAAATAC |
| | | TGTTCTTCTAGTGTAGCCGTAGTTAGGCCACCACTTCAAGAACTCTGTAGC |
| | | ACCGCCTACATACCTCGCTCTGCTAATCCTGTTACCAGTGGCTGCTGCCAG |
| | | TGGCGATAAGTCGTGTCTTACCGGGTTGGACTCAAGACGATAGTTACCGGA |
| | | TAAGGCGCAGCGGTCGGGCTGAACGGGGGGTTCGTGCACACAGCCCAGCTT |
| | | GGAGCGAACGACCTACACCGAACTGAGATACCTACAGCGTGAGCTATGAGA |
| | | AAGCGCCACGCTTCCCGAAGGGAGAAAGGCGGACAGGTATCCGGTAAGCGG |
| | | CAGGGTCGGAACAGGAGAGCGCACGAGGGAGCTTCCAGGGGGAAACGCCTG |
| | | GTATCTTTATAGTCCTGTCGGGTTTCGCCACCTCTGACTTGAGCGTCGATT |
| | | TTTGTGATGCTCGTCAGGGGGCGGAGCCTATGGAAAAACGCCAGCAACGC |
| | | GGCCTTTTTACGGTTCCTGGCCTTTTGCTGGCCTTTTGCTCACATGTTCTT |
| | | TCCTGCGTTATCCCCTGATTCTGTGGATAACCGTATTACCGCCTTTGAGTG |
| | | AGCTGATACCGCTCGCCGCAGCCGAACGACCGAGCGCAGCGAGTCAGTGAG |
| | | CGAGGAAGCGGAAGAGCGCCCAATACGCAAACCGCCTCTCCCCGCGCGTTG |
| | | GCCGATTCATTAATGCAGCTGGCACGACAGGTTTCCCGACTGGAAAGCGGG |
| | | CAGTGAGCGCAACGCAATTAATGTGAGTTAGCTCACTCATTAGGCACCCCA |

TABLE 226-continued

| Vector name | SEQ ID NO | Nucleotide sequences<br>1234567890123456789012345678901234567890123456789012345678901 |
|---|---|---|
| | | GGCTTTACACTTTATGCTTCCGGCTCGTATGTTGTGTGGAATTGTGAGCGG<br>ATAACAATTTCACACAGGAAACAGCTATGACCATGATTACGCCAAGCTCTA<br>GCTAGAGGTCGAGTCCCTCCCCAGCAGGCAGAAGTATGCAAAGCATGCTAC<br>TCAATTAGTCAGCAACCATAGTCCCGCCCCTAACTCCGCCCATCCCGCCCC<br>TAACTCCGCCCAGTTCCGCCCATTCTCCGCCCCATGGCTGACTAATTTTTT<br>TTATTTATGCAGAGGCCGAGGCGCCTCGGCCTCTGAGCTATTCCAGAAGT<br>AGTGAGGAGGCTTTTTTGGAGGCCTAGGCTTTTGCAAAAAGCTTTGCAAAG<br>ATGGATAAAGTTTTAAACAGAGAGGAATCTTTGCAGCTAATGGACCTTCTA<br>GGTCTTGAAAGGAGTGGGAATTGGCTCCGGTGCCCGTCAGTGGGCAGAGCG<br>CACATCGCCCACAGTCCCCGAGAAGTTGGGGGGAGGGGTCGGCAATTGAAC<br>CGGTGCCTAGAGAAGGTGGCGCGGGGTAAACTGGGAAAGTGATGTCGTGTA<br>CTGGCTCCGCCTTTTTCCCGAGGGTGGGGGAGAACCGTATATAAGTGCAGT<br>AGTCGCCGTGAACGTTCTTTTTCGCAACGGGTTTGCCGCCAGAACACAGGT<br>AAGTGCCGTGTGTGGTTCCCGCGGGCCTGGCCTCTTTACGGGTTATGGCCC<br>TTGCGTGCCTTGAATTACTTCCACCTGGCTGCAGTACGTGATTCTTGATCC<br>CGAGCTTCGGGTTGGAAGTGGGTGGGAGAGTTCGAGGCCTTGCGCTTAAGG<br>AGCCCCTTCGCCTCGTGCTTGAGTTGAGGCCTGGCCTGGGCGCTGGGGCCG<br>CCGCGTGCGAATCTGGTGGCACCTTCGCGCCTGTCTCGCTGCTTTCGATAA<br>GTCTCTAGCCATTTAAAATTTTTGATGACCTGCTGCGACGCTTTTTTTCTG<br>GCAAGATAGTCTTGTAAATGCGGGCCAAGATCTGCACACTGGTATTTCGGT<br>TTTTGGGGCCGCGGGCGGCGACGGGGCCCGTGCGTCCCAGCGCACATGTTC<br>GGCGAGGCGGGGCCTGCGAGCGCGGCCACCGAGAATCGGACGGGGGTAGTC<br>TCAAGCTGGCCGGCCTGCTCTGGTGCCTGGCCTCGCGCCGCCGTGTATCGC<br>CCCGCCCTGGGCGGCAAGGCTGGCCCGGTCGGCACCAGTTGCGTGAGCGGA<br>AAGATGGCCGCTTCCCGGCCCTGCTGCAGGGAGCTCAAAATGGAGGACGCG<br>GCGCTCGGGAGAGCGGGCGGGTGAGTCACCCACACAAAGGAAAAGGGCCTT<br>TCCGTCCTCAGCCGTCGCTTCATGTGACTCCACGGAGTACCGGGCGCCGTC<br>CAGGCACCTCGATTAGTTCTCGAGCTTTTGGAGTACGTCGTCTTTAGGTTG<br>GGGGGAGGGGTTTTATGCGATGGAGTTTCCCCACACTGAGTGGGTGGAGAC<br>TGAAGTTAGGCCAGCTTGGCACTTGATGTAATTCTCCTTGGAATTTGCCCT<br>TTTTGAGTTTGGATCTTGGTTCATTCTCAAGCCTCAGACAGTGGTTCAAAG<br>TTTTTTTCTTCCATTTCAGGTGTCGTGAGGAATTCTCTAGAGATCCCTCGA<br>CCTCGAGATCCATTGTGCCCGGGCGCACCATGGACATGCGCGTGCCCGCCC<br>AGCTGCTGGGCCTGCTGCTGCTGTGGTTCCCCGGCTCGCGATGC |
| V3 | 869 | CAACCCAAGGCTGCCCCCTCGGTCACTCTGTTCCCGCCCTCCTCTGAGGAG<br>CTTCAAGCCAACAAGGCCACACTGGTGTGTCTCATAAGTGACTTCTACCCG<br>GGAGCCGTGACAGTGGCCTGGAAGGCAGATAGCAGCCCCGTCAAGGCGGGA<br>GTGGAGACCACCACACCCTCCAAACAAAGCAACAACAAGTACGCGGCCAGC<br>AGCTACCTGAGCCTGACGCCTGAGCAGTGGAAGTCCCACAGAAGCTACAGC<br>TGCCAGGTCACGCATGAAGGGAGCACCGTGGAGAAGACAGTGGCCCCTACA<br>GAATGTTCATGAGCGGCCGCTCGAGGCCGGCAAGGCCGGATCCCCCGACCT<br>CGACCTCTGGCTAATAAAGGAAATTTATTTTCATTGCAATAGTGTGTTGGA<br>ATTTTTTGTGTCTCTCACTCGGAAGGACATATGGGAGGGCAAATCATTTGG<br>TCGAGATCCCTCGGAGATCTCTAGCTAGAGGATCGATCCCCGCCCCGGACG<br>AACTAAACCTGACTACGACATCTCTGCCCCTTCTTCGCGGGGCAGTGCATG<br>TAATCCCTTCAGTTGGTTGGTACAACTTGCCAACTGGGCCCTGTTCCACAT<br>GTGACACGGGGGGGGACCAAACACAAAGGGGTTCTCTGACTGTAGTTGACA<br>TCCTTATAAATGGATGTGCACATTTGCCAACACTGAGTGGCTTTCATCCTG<br>GAGCAGACTTTGCAGTCTGTGGACTGCAACACAACATTGCCTTTATGTGTA<br>ACTCTTGGCTGAAGCTCTTACACCAATGCTGGGGGACATGTACCTCCCAGG<br>GGCCCAGGAAGACTACGGGAGGCTACACCAACGTCAATCAGAGGGGCCTGT<br>GTAGCTACCGATAAGCGGACCCTCAAGAGGGCATTAGCAATAGTGTTTATA<br>AGGCCCCCTTGTTAACCCTAAACGGGTAGCATATGCTTCCCGGGTAGTAGT<br>ATATACTATCCAGACTAACCCTAATTCAATAGCATATGTTACCCAACGGGA<br>AGCATATGCTATCGAATTAGGGTTAGTAAAAGGGTCCTAAGGAACAGCGAT<br>ATCTCCCACCCCATGAGCTGTCACGGTTTTATTTACATGGGGTCAGGATTC<br>CACGAGGGTAGTGAACCATTTTAGTCACAAGGGCAGTGGCTGAAGATCAAG<br>GAGCGGGCAGTGAACTCTCCTGAATCTTCGCCTGCTTCTTCATTCTCCTTC<br>GTTTAGCTAATAGAATAACTGCTGAGTTGTGAACAGTAAGGTGTATGTGAG<br>GTGCTCGAAAACAAGGTTTCAGGTGACGCCCCAGAATAAAATTTGGACGG<br>GGGGTTCAGTGGTGGCATTGTGCTATGACACCAATATAACCCTCACAAACC<br>CCTTGGGCAATAAATACTAGTGTAGGAATGAAACATTCTGAATATCTTTAA<br>CAATAGAAATCCATGGGGTGGGGACAAGCCGTAAAGACTGGATGTCCATCT<br>CACACGAATTTATGGCTATGGGCAACACATAATCCTAGTGCAATATGATAC<br>TGGGGTTATTAAGATGTGTCCCAGGCAGGGACCAAGACAGGTGAACCATGT<br>TGTTACACTCTATTTGTAACAAGGGGAAAGAGAGTGGACGCCGACAGCAGC<br>GGACTCCACTGGTTGTCTCTAACACCCCCGAAAATTAAACGGGGCTCCACG<br>CCAATGGGCCCATAAACAAAGACAAGTGGCCACTCTTTTTTTTGAAATTG<br>TGGAGTGGGGCACGCGTCAGCCCCCACACGCCGCCCTGCGGTTTTGGACT<br>GTAAAATAAGGGTGTAATAACTTGGCTGATTGTAACCCCGCTAACCACTGC<br>GGTCAAACCACTTGCCCACAAAACCACTAATGGCACCCCGGGGAATACCTG<br>CATAAGTAGGTGGGCGGGCAAGATAGGGGCGCGATTGCTGCGATCTGGAG<br>GACAAATTACACACACTTGCGCCTGAGCGCAAGCACAGGGTTGTTGGTCC<br>TCATATTCACGAGGTCGCTGAGAGCACGGTGGGCTAATGTTGCCATGGGTA<br>GCATATACTACCCAAATATCTGGATAGCATATGCTATCCTAATCTATATCT<br>GGGTAGCATAGGCTATCCTAATCTATATCTGGGTAGCATATGCTATCCTAA |

TABLE 226-continued

| Vector name | SEQ ID NO | Nucleotide sequences 12345678901234567890123456789012345678901234567890 1 |
|---|---|---|
| | | TCTATATCTGGGTAGTATATGCTATCCTAATTTATATCTGGGTAGCATAGG |
| | | CTATCCTAATCTATATCTGGGTAGCATATGCTATCCTAATCTATATCTGGG |
| | | TAGTATATGCTATCCTAATCTGTATCCGGGTAGCATATGCTATCCTAATAG |
| | | AGATTAGGGTAGTATATGCTATCCTAATTTATATCTGGGTAGCATATACTA |
| | | CCCAAATATCTGGATAGCATATGCTATCCTAATCTATATCTGGGTAGCATA |
| | | TGCTATCCTAATCTATATCTGGGTAGCATAGGCTATCCTAATCTATATCTG |
| | | GGTAGCATATGCTATCCTAATCTATATCTGGGTAGTATATGCTATCCTAAT |
| | | TTATATCTGGGTAGCATAGGCTATCCTAATCTATATCTGGGTAGCATATGC |
| | | TATCCTAATCTATATCTGGGTAGTATATGCTATCCTAATCTGTATCCGGGT |
| | | AGCATATGCTATCCTCATGATAAGCTGTCAAACATGAGAATTTTCTTGAAG |
| | | ACGAAAGGGCCTCGTGATACGCCTATTTTTATAGGTTAATGTCATGATAAT |
| | | AATGGTTTCTTAGACGTCAGGTGGCACTTTTCGGGGAAATGTGCGCGGAAC |
| | | CCCTATTTGTTTATTTTTCTAAATACATTCAAATATGTATCCGCTCATGAG |
| | | ACAATAACCCTGATAAATGCTTCAATAATATTGAAAAAGGAAGAGTATGAG |
| | | TATTCAACATTTCCGTGTCGCCCTTATTCCCTTTTTTGCGGCATTTTGCCT |
| | | TCCTGTTTTTGCTCACCCAGAAACGCTGGTGAAAGTAAAAGATGCTGAAGA |
| | | TCAGTTGGGTGCACGAGTGGGTTACATCGAACTGGATCTCAACAGCGGTAA |
| | | GATCCTTGAGAGTTTTCGCCCCGAAGAACGTTTTCCAATGATGAGCACTTT |
| | | TAAAGTTCTGCTATGTGGCGCGGTATTATCCCGTGTTGACGCCGGGCAAGA |
| | | GCAACTCGGTCGCCGCATACACTATTCTCAGAATGACTTGGTTGAGTACTC |
| | | ACCAGTCACAGAAAAGCATCTTACGGATGGCATGACAGTAAGAGAATTATG |
| | | CAGTGCTGCCATAACCATGAGTGATAACACTGCGGCCAACTTACTTCTGAC |
| | | AACGATCGGAGGACCGAAGGAGCTAACCGCTTTTTTGCACAACATGGGGGA |
| | | TCATGTAACTCGCCTTGATCGTTGGGAACCGGAGCTGAATGAAGCCATACC |
| | | AAACGACGAGCGTGACACCACGATGCCTGCAGCAATGGCAACAACGTTGCG |
| | | CAAACTATTAACTGGCGAACTACTTACTCTAGCTTCCCGGCAACAATTAAT |
| | | AGACTGGATGGAGGCGGATAAAGTTGCAGGACCACTTCTGCGCTCGGCCCT |
| | | TCCGGCTGGCTGGTTTATTGCTGATAAATCTGGAGCCGGTGAGCGTGGGTC |
| | | TCGCGGTATCATTGCAGCACTGGGGCCAGATGGTAAGCCCTCCCGTATCGT |
| | | AGTTATCTACACGACGGGGAGTCAGGCAACTATGGATGAACGAAATAGACA |
| | | GATCGCTGAGATAGGTGCCTCACTGATTAAGCATTGGTAACTGTCAGACCA |
| | | AGTTTACTCATATATACTTTAGATTGATTTAAAACTTCATTTTTAATTTAA |
| | | AAGGATCTAGGTGAAGATCCTTTTTGATAATCTCATGACCAAAATCCCTTA |
| | | ACGTGAGTTTTCGTTCCACTGAGCGTCAGACCCCGTAGAAAAGATCAAAGG |
| | | ATCTTCTTGAGATCCTTTTTTTCTGCGCGTAATCTGCTGCTTGCAAACAAA |
| | | AAAACCACCGCTACCAGCGGTGGTTTGTTTGCCGGATCAAGAGCTACCAAC |
| | | TCTTTTTCCGAAGGTAACTGGCTTCAGCAGAGCGCAGATACCAAATACTGT |
| | | TCTTCTAGTGTAGCCGTAGTTAGGCCACCACTTCAAGAACTCTGTAGCACC |
| | | GCCTACATACCTCGCTCTGCTAATCCTGTTACCAGTGGCTGCTGCCAGTGG |
| | | CGATAAGTCGTGTCTTACCGGGTTGGACTCAAGACGATAGTTACCGGATAA |
| | | GGCGCAGCGGTCGGGCTGAACGGGGGGTTCGTGCACACAGCCCAGCTTGGA |
| | | GCGAACGACCTACACCGAACTGAGATACCTACAGCGTGAGCTATGAGAAAG |
| | | CGCCACGCTTCCCGAAGGGAGAAAGGCGGACAGGTATCCGGTAAGCGGCAG |
| | | GGTCGGAACAGGAGAGCGCACGAGGGAGCTTCCAGGGGGAAACGCCTGGTA |
| | | TCTTTATAGTCCTGTCGGGTTTCGCCACCTCTGACTTGAGCGTCGATTTTT |
| | | GTGATGCTCGTCAGGGGGCGGAGCCTATGGAAAAACGCCAGCAACGCGGC |
| | | CTTTTTACGGTTCCTGGCCTTTTGCTGGCCTTTTGCTCACATGTTCTTTCC |
| | | TGCGTTATCCCCTGATTCTGTGGATAACCGTATTACCGCCTTTGAGTGAGC |
| | | TGATACCGCTCGCCGCAGCCGAACGACCGAGCGCAGCGAGTCAGTGAGCGA |
| | | GGAAGCGGAAGAGCGCCCAATACGCAAACCGCCTCTCCCCGCGCGTTGGCC |
| | | GATTCATTAATGCAGCTGGCACGACAGGTTTCCCGACTGGAAAGCGGGCAG |
| | | TGAGCGCAACGCAATTAATGTGAGTTAGCTCACTCATTAGGCACCCCAGGC |
| | | TTTACACTTTATGCTTCCGGCTCGTATGTTGTGTGGAATTGTGAGCGGATA |
| | | ACAATTTCACACAGGAAACAGCTATGACCATGATTACGCCAAGCTCTAGCT |
| | | AGAGGTCGAGTCCCTCCCCAGCAGGCAGAAGTATGCAAAGCATGCATCTCA |
| | | ATTAGTCAGCAACCATAGTCCCGCCCCTAACTCCGCCCATCCCGCCCCTAA |
| | | CTCCGCCCAGTTCCGCCCATTCTCCGCCCCATGGCTGACTAATTTTTTTTA |
| | | TTTATGCAGAGGCCGAGGCCGCCTCGGCCTCTGAGCTATTCCAGAAGTAGT |
| | | GAGGAGGCTTTTTTGGAGGCCTAGGCTTTTGCAAAAAGCTTTGCAAAGATG |
| | | GATAAAGTTTTAAACAGAGAGGAATCTTTGCAGCTAATGGACCTTCTAGGT |
| | | CTTGAAAGGAGTGGGAATTGGCTCCGGTGCCCGTCAGTGGGCAGAGCGCAC |
| | | ATCGCCCACAGTCCCCGAGAAGTTGGGGGGAGGGGTCGGCAATTGAACCGG |
| | | TGCCTAGAGAAGGTGGCGCGGGGTAAACTGGGAAAGTGATGTCGTGTACTG |
| | | GCTCCGCCTTTTTCCCGAGGGTGGGGGAGAACCGTATATAAGTGCAGTAGT |
| | | CGCCGTGAACGTTCTTTTTCGCAACGGGTTTGCCGCCAGAACACAGGTAAG |
| | | TGCCGTGTGTGGTTCCCGCGGGCCTGGCCTCTTTACGGGTTATGGCCCTTG |
| | | CGTGCCTTGAATTACTTCCACCTGGCTGCAGTACGTGATTCTTGATCCCGA |
| | | GCTTCGGGTTGGAAGTGGGTGGGAGAGTTCGAGGCCTTGCGCTTAAGGAGC |
| | | CCCTTCGCCTCGTGCTTGAGTTGAGGCCTGGCCTGGGCGCTGGGGCCGCCG |
| | | CGTGCGAATCTGGTGGCACCTTCGCGCCTGTCTCGCTGCTTTCGATAAGTC |
| | | TCTAGCCATTTAAAATTTTTGATGACCTGCTGCGACGCTTTTTTTCTGGCA |
| | | AGATAGTCTTGTAAATGCGGGCCAAGATCTGCACACTGGTATTTCGGTTTT |
| | | TGGGGCCGCGGGCGGCGACGGGGCCCGTGCGTCCCAGCGCACATGTTCGGC |
| | | GAGGCGGGGCCTGCGAGCGCGGCCACCGAGAATCGGACGGGGGTAGTCTCA |
| | | AGCTGGCCGGCCTGCTCTGGTGCCTGGCCTCGCGCCGCCGTGTATCGCCCC |
| | | GCCCTGGGCGGCAAGGCTGGCCCGGTCGGCACCAGTTGCGTGAGCGGAAAG |
| | | ATGGCCGCTTCCCGGCCCTGCTGCAGGGAGCTCAAAATGGAGGACGCGGCG |

TABLE 226-continued

| Vector name | SEQ ID NO | Nucleotide sequences 12345678901234567890123456789012345678901234567 8901 |
|---|---|---|
| | | CTCGGGAGAGCGGGCGGGTGAGTCACCCACACAAAGGAAAAGGGCCTTTCC GTCCTCAGCCGTCGCTTCATGTGACTCCACGGAGTACCGGGCGCCGTCCAG GCACCTCGATTAGTTCTCGAGCTTTTGGAGTACGTCGTCTTTAGGTTGGGG GGAGGGGTTTTATGCGATGGAGTTTCCCCACACTGAGTGGGTGGAGACTGA AGTTAGGCCAGCTTGGCACTTGATGTAATTCTCCTTGGAATTTGCCCTTTT TGAGTTTGGATCTTGGTTCATTCTCAAGCCTCAGACAGTGGTTCAAAGTTT TTTTCTTCCATTTCAGGTGTCGTGAGGAATTCTCTAGAGATCCCTCGACCT CGAGATCCATTGTGCCCGGGCGCCACCATGACTTGGACCCCACTCCTCTTC CTCACCCTCCTCCTCCACTGCACAGGAAGCTTATCG |
| V4 | 870 | ACGGTGGCTGCACCATCTGTCTTCATCTTCCCGCCATCTGATGAGCAGTTG AAATCTGGAACTGCCTCTGTTGTGTGCCTGCTGAATAACTTCTATCCCAGA GAGGCCAAAGTACAGTGGAAGGTGGATAACGCCCTCCAATCGGGTAACTCC CAGGAGAGTGTCACAGAGCAGGACAGCAAGGACAGCACCTACAGCCTCAGC AGCACCCTGACGCTGAGCAAAGCAGACTACGAGAAACACAAAGTCTACGCC TGCGAAGTCACCCATCAGGGCCTGAGCTCGCCCGTCACAAAGAGCTTCAAC AGGGGAGAGTGTTGAGCGGCCGCTCGAGGCCGGCAAGGCCGGATCCCCCGA CCTCGACCTCTGGCTAATAAAGGAAATTTATTTTCATTGCAATAGTGTGTT GGAATTTTTTGTGTCTCTCACTCGGAAGGACATATGGGAGGGCAAATCATT TGGTCGAGATCCCTCGGAGATCTCTAGCTAGAGGATCGATCCCCGCCCCGG ACGAACTAAACCTGACTACGACATCTCTGCCCCTTCTTCGCGGGGCAGTGC ATGTAATCCCTTCAGTTGGTTGGTACAACTTGCCAACTGGGCCTGTTCCA CATGTGACACGGGGGGGACCAAACACAAAGGGGTTCTCTGACTGTAGTTG ACATCCTTATAAATGGATGTGCACATTTGCCAACACTGAGTGGCTTTCATC CTGGAGCAGACTTTGCAGTCTGTGGACTGCAACACAACATTGCCTTTATGT GTAACTCTTGGCTGAAGCTCTTACACCAATGCTGGGGGACATGTACCTCCC AGGGGCCCAGGAAGACTACGGGAGGCTACACCAACGTCAATCAGAGGGGCC TGTGTAGCTACCGATAAGCGGACCCTCAAGAGGGCATTAGCAATAGTGTTT ATAAGGCCCCCTTGTTAACCCTAAACGGGTAGCATATGCTTCCCGGGTAGT AGTATATACTATCCAGACTAACCCTAATTCAATAGCATATGTTACCCAACG GGAAGCATATGCTATCGAATTAGGGTTAGTAAAAGGGTCCTAAGGAACAGC GATATCTCCCACCCCATGAGCTGTCACGGTTTTATTTACATGGGGTCAGGA TTCCACGAGGGTAGTGAACCATTTTAGTCACAAGGGCAGTGGCTGAAGATC AAGGAGCGGGCAGTGAACTCTCCTGAATCTTCGCCTGCTTCTTCATTCTCC TTCGTTTAGCTAATAGAATAACTGCTGAGTTGTGAACAGTAAGGTGTATGT GAGGTGCTCGAAAACAAGGTTTCAGGTGACGCCCCCAGAATAAAATTTGGA CGGGGGGTTCAGTGGTGGCATTGTGCTATGACACCAATATAACCCTCACAA ACCCCCTTGGGCAATAAATACTAGTGTAGGAATGAAACATTCTGAATATCTT TAACAATAGAAATCCATGGGGTGGGACAAGCCGTAAAGACTGGATGTCCA TCTCACACGAATTTATGGCTATGGGCAACACATAATCCTAGTGCAATATGA TACTGGGGTTATTAAGATGTGTCCCAGGCAGGGACCAAGACAGGTGAACCA TGTTGTTACACTCTATTTGTAACAAGGGGAAAGAGAGTGGACGCCGACAGC AGCGGACTCCACTGGTTGTCTCTAACACCCCCGAAAATTAAACGGGGCTCC ACGCCAATGGGGCCCATAAACAAAGACAAGTGGCCACTCTTTTTTTTGAAA TTGTGGAGTGGGGGCACGCGTCAGCCCCCACACGCCGCCCTGCGGTTTTGG ACTGTAAAATAAGGGTGTAATAACTTGGCTGATTGTAACCCCGCTAACCAC TGCGGTCAAACCACTTGCCCACAAAACCACTAATGGCACCCCGGGGAATAC CTGCATAAGTAGGTGGGCGGGCCAAGATAGGGGCGCGATTGCTGCGATCTG GAGGACAAATTACACACACTTGCGCCTGAGCGCCAAGCACAGGGTTGTTGG TCCTCATATTCACGAGGTCGCTGAGAGCACGGTGGGCTAATGTTGCCATGG GTAGCATATACTACCCAAATATCTGGATAGCATATGCTATCCTAATCTATA TCTGGGTAGCATAGGCTATCCTAATCTATATCTGGGTAGCATATGCTATCC TAATCTATATCTGGGTAGTATATGCTATCCTAATTTATATCTGGGTAGCAT AGGCTATCCTAATCTATATCTGGGTAGCATATGCTATCCTAATCTATATCT GGGTAGTATATGCTATCCTAATCTGTATCCGGGTAGCATATGCTATCCTAA TAGAGATTAGGGTAGTATATGCTATCCTAATTTATATCTGGGTAGCATATA CTACCCAAATATCTGGATAGCATATGCTATCCTAATCTATATCTGGGTAGC ATATGCTATCCTAATCTATATCTGGGTAGCATAGGCTATCCTAATCTATAT CTGGGTAGCATATGCTATCCTAATCTATATCTGGGTAGTATATGCTATCCT AATTTATATCTGGGTAGCATAGGCTATCCTAATCTATATCTGGGTAGCATA TGCTATCCTAATCTATATCTGGGTAGTATATGCTATCCTAATCTGTATCCG GGTAGCATATGCTATCCTCATGATAAGCTGTCAAACATGAGAATTTTCTTG AAGACGAAAGGGCCTCGTGATACGCCTATTTTTATAGGTTAATGTCATGAT AATAATGGTTTCTTAGACGTCAGGTGGCACTTTTCGGGGAAATGTGCGCGG AACCCCTATTTGTTTATTTTTCTAAATACATTCAAATATGTATCCGCTCAT GAGACAATAACCCTGATAAATGCTTCAATAATATTGAAAAAGGAAGAGTAT GAGTATTCAACATTTCCGTGTCGCCCTTATTCCCTTTTTTGCGGCATTTTG CCTTCCTGTTTTTGCTCACCCAGAAACGCTGGTGAAAGTAAAAGATGCTGA AGATCAGTTGGGTGCACGAGTGGGTTACATCGAACTGGATCTCAACAGCGG TAAGATCCTTGAGAGTTTTCGCCCCGAAGAACGTTTTCCAATGATGAGCAC TTTTAAAGTTCTGCTATGTGGCGCGGTATTATCCCGTGTTGACGCCGGGCA AGAGCAACTCGGTCGCCGCATACACTATTCTCAGAATGACTTGGTTGAGTA CTCACCAGTCACAGAAAAGCATCTTACGGATGGCATGACAGTAAGAGAATT ATGCAGTGCTGCCATAACCATGAGTGATAACACTGCGGCCAACTTACTTCT GACAACGATCGGAGGACCGAAGGAGCTAACCGCTTTTTTGCACAACATGGG GGATCATGTAACTCGCCTTGATCGTTGGGAACCGGAGCTGAATGAAGCCAT ACCAAACGACGAGCGTGACACCACGATGCCTGCAGCAATGGCAACAACGTT |

TABLE 226-continued

| Vector name | SEQ ID NO | Nucleotide sequences |
|---|---|---|
| | | GCGCAAACTATTAACTGGCGAACTACTTACTCTAGCTTCCCGGCAACAATT |
| | | AATAGACTGGATGGAGGCGGATAAAGTTGCAGGACCACTTCTGCGCTCGGC |
| | | CCTTCCGGCTGGCTGGTTTATTGCTGATAAATCTGGAGCCGGTGAGCGTGG |
| | | GTCTCGCGGTATCATTGCAGCACTGGGGCCAGATGGTAAGCCCTCCCGTAT |
| | | CGTAGTTATCTACACGACGGGGAGTCAGGCAACTATGGATGAACGAAATAG |
| | | ACAGATCGCTGAGATAGGTGCCTCACTGATTAAGCATTGGTAACTGTCAGA |
| | | CCAAGTTTACTCATATATACTTTAGATTGATTTAAAACTTCATTTTTAATT |
| | | TAAAAGGATCTAGGTGAAGATCCTTTTTGATAATCTCATGACCAAATCCC |
| | | TTAACGTGAGTTTTCGTTCCACTGAGCGTCAGACCCCGTAGAAAAGATCAA |
| | | AGGATCTTCTTGAGATCCTTTTTTTCTGCGCGTAATCTGCTGCTTGCAAAC |
| | | AAAAAAACCACCGCTACCAGCGGTGGTTTGTTTGCCGGATCAAGAGCTACC |
| | | AACTCTTTTTCCGAAGGTAACTGGCTTCAGCAGAGCGCAGATACCAAATAC |
| | | TGTTCTTCTAGTGTAGCCGTAGTTAGGCCACCACTTCAAGAACTCTGTAGC |
| | | ACCGCCTACATACCTCGCTCTGCTAATCCTGTTACCAGTGGCTGCTGCCAG |
| | | TGGCGATAAGTCGTGTCTTACCGGGTTGGACTCAAGACGATAGTTACCGGA |
| | | TAAGGCGCAGCGGTCGGGCTGAACGGGGGGTTCGTGCACACAGCCCAGCTT |
| | | GGAGCGAACGACCTACACCGAACTGAGATACCTACAGCGTGAGCTATGAGA |
| | | AAGCGCCACGCTTCCCGAAGGGAGAAAGGCGGACAGGTATCCGGTAAGCGG |
| | | CAGGGTCGGAACAGGAGAGCGCACGAGGGAGCTTCCAGGGGGAAACGCCTG |
| | | GTATCTTTATAGTCCTGTCGGGTTTCGCCACCTCTGACTTGAGCGTCGATT |
| | | TTTGTGATGCTCGTCAGGGGGCGGAGCCTATGGAAAAACGCCAGCAACGC |
| | | GGCCTTTTTACGGTTCCTGGCCTTTTGCTGGCCTTTTGCTCACATGTTCTT |
| | | TCCTGCGTTATCCCCTGATTCTGTGGATAACCGTATTACCGCCTTTGAGTG |
| | | AGCTGATACCGCTCGCCGCAGCCGAACGACCGAGCGCAGCGAGTCAGTGAG |
| | | CGAGGAAGCGGAAGAGCGCCCAATACGCAAACCGCCTCTCCCCGCGCGTTG |
| | | GCCGATTCATTAATGCAGCTGGCACGACAGGTTTCCCGACTGGAAAGCGGG |
| | | CAGTGAGCGCAACGCAATTAATGTGAGTTAGCTCACTCATTAGGCACCCCA |
| | | GGCTTTACACTTTATGCTTCCGGCTCGTATGTTGTGTGGAATTGTGAGCGG |
| | | ATAACAATTTCACACAGGAAACAGCTATGACCATGATTACGCCAAGCTCTA |
| | | GCTAGAGGTCGAGTCCCTCCCCAGCAGGCAGAAGTATGCAAAGCATGCATC |
| | | TCAATTAGTCAGCAACCATAGTCCCGCCCCTAACTCCGCCCATCCCGCCCC |
| | | TAACTCCGCCCAGTTCCGCCCATTCTCCGCCCCATGGCTGACTAATTTTTT |
| | | TTATTTATGCAGAGGCCGAGGCCGCCTCGGCCTCTGAGCTATTCCAGAAGT |
| | | AGTGAGGAGGCTTTTTTGGAGGCCTAGGCTTTTGCAAAAAGCTTTGCAAAG |
| | | ATGGATAAAGTTTTAAACAGAGAGGAATCTTTGCAGCTAATGACCTTCTA |
| | | GGTCTTGAAAGGAGTGGGAATTGGCTCCGGTGCCCGTCAGTGGGCAGAGCG |
| | | CACATCGCCCACAGTCCCCGAGAAGTTGGGGGGAGGGGTCGGCAATTGAAC |
| | | CGGTGCCTAGAGAAGGTGGCGCGGGGTAAACTGGGAAAGTGATGTCGTGTA |
| | | CTGGCTCCGCCTTTTTCCCGAGGGTGGGGGAGAACCGTATATAAGTGCAGT |
| | | AGTCGCCGTGAACGTTCTTTTTCGCAACGGGTTTGCCGCCAGAACACAGGT |
| | | AAGTGCCGTGTGTGGTTCCCGCGGGCCTGGCCTCTTTACGGGTTATGGCCC |
| | | TTGCGTGCCTTGAATTACTTCCACCTGGCTGCAGTACGTGATTCTTGATCC |
| | | CGAGCTTCGGGTTGGAAGTGGGTGGGAGAGTTCGAGGCCTTGCGCTTAAGG |
| | | AGCCCCTTCGCCTCGTGCTTGAGTTGAGGCCTGGCCTGGGCGCTGGGGCCG |
| | | CCGCGTGCGAATCTGGTGGCACCTTCGCGCCTGTCTCGCTGCTTTCGATAA |
| | | GTCTCTAGCCATTTAAAATTTTTGATGACCTGCTGCGACGCTTTTTTTCTG |
| | | GCAAGATAGTCTTGTAAATGCGGGCCAAGATCTGCACACTGGTATTTCGGT |
| | | TTTTGGGGCCGCGGGCGGCGACGGGGCCCGTGCGTCCCAGCGCACATGTTC |
| | | GGCGAGGCGGGGCCTGCGAGCGCGGCCACCGAGAATCGGACGGGGTAGTC |
| | | TCAAGCTGGCCGGCCTGCTCTGGTGCCTGGCCTCGCGCCGCCGTGTATCGC |
| | | CCCGCCCTGGGCGGCAAGGCTGGCCCGGTCGGCACCAGTTGCGTGAGCGGA |
| | | AAGATGGCCGCTTCCCGGCCCTGCTGCAGGGAGCTCAAAATGGAGGACGCG |
| | | GCGCTCGGGAGAGCGGGCGGGTGAGTCACCCACACAAAGGAAAAGGGCCTT |
| | | TCCGTCCTCAGCCGTCGCTTCATGTGACTCCACGGAGTACCGGGCGCCGTC |
| | | CAGGCACCTCGATTAGTTCTCGAGCTTTTGGAGTACGTCGTCTTTAGGTTG |
| | | GGGGGAGGGGTTTTATGCGATGGAGTTTCCCCACACTGAGTGGGTGGAGAC |
| | | TGAAGTTAGGCCAGCTTGGCACTTGATGTAATTCTCCTTGGAATTTGCCCT |
| | | TTTTGAGTTTGGATCTTGGTTCATTCTCAAGCCTCAGACAGTGGTTCAAAG |
| | | TTTTTTTCTTCCATTTCAGGTGTCGTGAGGAATTCTCTAGAGATCCCTCGA |
| | | CCTCGAGATCCATTGTGCCCGGCGCACCATGACTTGGACCCCACTCCTCT |
| | | TCCTCACCCTCCTCCTCACTGCACAGGAAGCTTATCG |
| V5 | 871 | CAACCCAAGGCTGCCCCCTCGGTCACTCTGTTCCCGCCCTCCTCTGAGGAG |
| | | CTTCAAGCCAACAAGGCCACACTGGTGTGTCTCATAAGTGACTTCTACCCG |
| | | GGAGCCGTGACAGTGGCCTGGAAGGCAGATAGCAGCCCCGTCAAGGCGGGA |
| | | GTGGAGACCACCACACCCTCCAAACAAAGCAACAACAAGTACGCGGCCAGC |
| | | AGCTACCTGAGCCTGACGCCTGAGCAGTGGAAGTCCCACAGAAGCTACAGC |
| | | TGCCAGGTCACGCATGAAGGGAGCACCGTGGAGAAGACAGTGGCCCCTACA |
| | | GAATGTTCATGAGCGGCCGCTCGAGGCCGGCAAGGCCGGATCCCCCGACCT |
| | | CGACCTCTGGCTAATAAAGGAAATTTATTTTCATTGCAATAGTGTGTTGGA |
| | | ATTTTTTGTGTCTCTCACTCGGAAGGACATATGGGAGGGCAAATCATTTGG |
| | | TCGAGATCCCTCGGAGATCTCTAGCTAGAGGATCGATCCCCGCCCCGGACG |
| | | AACTAAACCTGACTACGACATCTCTGCCCCTTCTTCGCGGGGCAGTGCATG |
| | | TAATCCCTTCAGTTGGTTGGTACAACTTGCCAACTGGGCCCTGTTCCACAT |
| | | GTGACACGGGGGGGGACCAAACACAAAGGGGTTCTCTGACTGTAGTTGACA |
| | | TCCTTATAAATGGATGTGCACATTTGCCAACACTGAGTGGCTTTCATCCTG |
| | | GAGCAGACTTTGCAGTCTGTGGACTGCAACACAACATTGCCTTTATGTGTA |

TABLE 226-continued

| Vector name | SEQ ID NO | Nucleotide sequences |
|---|---|---|
| | | ACTCTTGGCTGAAGCTCTTACACCAATGCTGGGGGACATGTACCTCCCAGG
GGCCCAGGAAGACTACGGGAGGCTACACCAACGTCAATCAGAGGGGCCTGT
GTAGCTACCGATAAGCGGACCCTCAAGAGGGCATTAGCAATAGTGTTTATA
AGGCCCCCTTGTTAACCCTAAACGGGTAGCATATGCTTCCCGGGTAGTAGT
ATATACTATCCAGACTAACCCTAATTCAATAGCATATGTTACCCAACGGGA
AGCATATGCTATCGAATTAGGGTTAGTAAAAGGGTCCTAAGGAACAGCGAT
ATCTCCCACCCCATGAGCTGTCACGGTTTTATTTACATGGGGTCAGGATTC
CACGAGGGTAGTGAACCATTTTAGTCACAAGGGCAGTGGCTGAAGATCAAG
GAGCGGGCAGTGAACTCTCCTGAATCTTCGCCTGCTTCTTCATTCTCCTTC
GTTTAGCTAATAGAATAACTGCTGAGTTGTGAACAGTAAGGTGTATGTGAG
GTGCTCGAAAACAAGGTTTCAGGTGACGCCCCAGAATAAAATTTGGACGG
GGGGTTCAGTGGTGGCATTGTGCTATGACACCAATATAACCCTCACAAACC
CCTTGGGCAATAAATACTAGTGTAGGAATGAAACATTCTGAATATCTTTAA
CAATAGAAATCCATGGGGTGGGACAAGCCGTAAAGACTGGATGTCCATCT
CACACGAATTTATGGCTATGGGCAACACATAATCCTAGTGCAATATGATAC
TGGGGTTATTAAGATGTGTCCCAGGCAGGGACCAAGACAGGTGAACCATGT
TGTTACACTCTATTTGTAACAAGGGGAAAGAGAGTGGACGCCGACAGCAGC
GGACTCCACTGGTTGTCTCTAACACCCCCGAAAATTAAACGGGGCTCCACG
CCAATGGGGCCCATAAACAAAGACAAGTGGCCACTCTTTTTTTTGAAATTG
TGGAGTGGGGGCACGCGTCAGCCCCCACACGCCGCCCTGCGGTTTTGGACT
GTAAAATAAGGGTGTAATAACTTGGCTGATTGTAACCCGCTAACCACTGC
GGTCAAACCACTTGCCCACAAAACCACTAATGGCACCCCGGGGAATACCTG
CATAAGTAGGTGGGCGGGCAAGATAGGGGCGCGATTGCTGCGATCTGGAG
GACAAATTACACACACTTGCGCCTGAGCGCCAAGCACAGGGTTGTTGGTCC
TCATATTCACGAGGTCGCTGAGAGCACGGTGGGCTAATGTTGCCATGGGTA
GCATATACTACCCAAATATCTGGATAGCATATGCTATCCTAATCTATATCT
GGGTAGCATAGGCTATCCTAATCTATATCTGGGTAGCATATGCTATCCTAA
TCTATATCTGGGTAGTATATGCTATCCTAATTTATATCTGGGTAGCATAGG
CTATCCTAATCTATATCTGGGTAGCATATGCTATCCTAATCTATATCTGGG
TAGTATATGCTATCCTAATCTGTATCCGGGTAGCATATGCTATCCTAATAG
AGATTAGGGTAGTATATGCTATCCTAATTTATATCTGGGTAGCATATACTA
CCCAAATATCTGGATAGCATATGCTATCCTAATCTATATCTGGGTAGCATA
TGCTATCCTAATCTATATCTGGGTAGCATAGGCTATCCTAATCTATATCTG
GGTAGCATATGCTATCCTAATCTATATCTGGGTAGTATATGCTATCCTAAT
TTATATCTGGGTAGCATAGGCTATCCTAATCTATATCTGGGTAGCATATGC
TATCCTAATCTATATCTGGGTAGTATATGCTATCCTAATCTGTATCCGGGT
AGCATATGCTATCCTCATGATAAGCTGTCAAACATGAGAATTTTCTTGAAG
ACGAAAGGGCCTCGTGATACGCCTATTTTTATAGGTTAATGTCATGATAAT
AATGGTTTCTTAGACGTCAGGTGGCACTTTTCGGGGAAATGTGCGCGGAAC
CCCTATTTGTTTATTTTTCTAAATACATTCAAATATGTATCCGCTCATGAG
ACAATAACCCTGATAAATGCTTCAATAATATTGAAAAAGGAAGAGTATGAG
TATTCAACATTTCCGTGTCGCCCTTATTCCCTTTTTTGCGGCATTTTGCCT
TCCTGTTTTTGCTCACCCAGAAACGCTGGTGAAAGTAAAAGATGCTGAAGA
TCAGTTGGGTGCACGAGTGGGTTACATCGAACTGGATCTCAACAGCGGTAA
GATCCTTGAGAGTTTTCGCCCCGAAGAACGTTTTCCAATGATGAGCACTTT
TAAAGTTCTGCTATGTGGCGCGGTATTATCCCGTGTTGACGCCGGGCAAGA
GCAACTCGGTCGCCGCATACACTATTCTCAGAATGACTTGGTTGAGTACTC
ACCAGTCACAGAAAAGCATCTTACGGATGGCATGACAGTAAGAGAATTATG
CAGTGCTGCCATAACCATGAGTGATAACACTGCGGCCAACTTACTTCTGAC
AACGATCGGAGGACCGAAGGAGCTAACCGCTTTTTTGCACAACATGGGGGA
TCATGTAACTCGCCTTGATCGTTGGGAACCGGAGCTGAATGAAGCCATACC
AAACGACGAGCGTGACACCACGATGCCTGCAGCAATGGCAACAACGTTGCG
CAAACTATTAACTGGCGAACTACTTACTCTAGCTTCCCGGCAACAATTAAT
AGACTGGATGGAGGCGGATAAAGTTGCAGGACCACTTCTGCGCTCGGCCCT
TCCGGCTGGCTGGTTTATTGCTGATAAATCTGGAGCCGGTGAGCGTGGGTC
TCGCGGTATCATTGCAGCACTGGGGCCAGATGGTAAGCCCTCCCGTATCGT
AGTTATCTACACGACGGGGAGTCAGGCAACTATGGATGAACGAAATAGACA
GATCGCTGAGATAGGTGCCTCACTGATTAAGCATTGGTAACTGTCAGACCA
AGTTTACTCATATATACTTTAGATTGATTTAAAACTTCATTTTTAATTTAA
AAGGATCTAGGTGAAGATCCTTTTTGATAATCTCATGACCAAAATCCCTTA
ACGTGAGTTTTCGTTCCACTGAGCGTCAGACCCCGTAGAAAAGATCAAAGG
ATCTTCTTGAGATCCTTTTTTTCTGCGCGTAATCTGCTGCTTGCAAACAAA
AAAACCACCGCTACCAGCGGTGGTTTGTTTGCCGGATCAAGAGCTACCAAC
TCTTTTTCCGAAGGTAACTGGCTTCAGCAGAGCGCAGATACCAAATACTGT
TCTTCTAGTGTAGCCGTAGTTAGGCCACCACTTCAAGAACTCTGTAGCACC
GCCTACATACCTCGCTCTGCTAATCCTGTTACCAGTGGCTGCTGCCAGTGG
CGATAAGTCGTGTCTTACCGGGTTGGACTCAAGACGATAGTTACCGGATAA
GGCGCAGCGGTCGGGCTGAACGGGGGGTTCGTGCACACAGCCCAGCTTGGA
GCGAACGACCTACACCGAACTGAGATACCTACAGCGTGAGCTATGAGAAAG
CGCCACGCTTCCCGAAGGGAGAAAGGCGGACAGGTATCCGGTAAGCGGCAG
GGTCGGAACAGGAGAGCGCACGAGGGAGCTTCCAGGGGGAAACGCCTGGTA
TCTTTATAGTCCTGTCGGGTTTCGCCACCTCTGACTTGAGCGTCGATTTTT
GTGATGCTCGTCAGGGGGGCGGAGCCTATGGAAAAACGCCAGCAACGCGGC
CTTTTTACGGTTCCTGGCCTTTTGCTGGCCTTTTGCTCACATGTTCTTTCC
TGCGTTATCCCCTGATTCTGTGGATAACCGTATTACCGCCTTTGAGTGAGC
TGATACCGCTCGCCGCAGCCGAACGACCGAGCGCAGCGAGTCAGTGAGCGA
GGAAGCGGAAGAGCGCCCAATACGCAAACCGCCTCTCCCCGCGCGTTGGCC |

TABLE 226-continued

| Vector name | SEQ ID NO | Nucleotide sequences |
|---|---|---|
| | | GATTCATTAATGCAGCTGGCACGACAGGTTTCCCGACTGGAAAGCGGGCAG
TGAGCGCAACGCAATTAATGTGAGTTAGCTCACTCATTAGGCACCCCAGGC
TTTACACTTTATGCTTCCGGCTCGTATGTTGTGTGGAATTGTGAGCGGATA
ACAATTTCACACAGGAAACAGCTATGACCATGATTACGCCAAGCTCTAGCT
AGAGGTCGAGTCCCTCCCCAGCAGGCAGAAGTATGCAAAGCATGCATCTCA
ATTAGTCAGCAACCATAGTCCCGCCCCTAACTCCGCCCATCCCGCCCCTAA
CTCCGCCCAGTTCCGCCCATTCTCCGCCCCATGGCTGACTAATTTTTTTTA
TTTATGCAGAGGCCGAGGCCGCTCGGCCTCTGAGCTATTCCAGAAGTAGT
GAGGAGGCTTTTTTGGAGGCCTAGGCTTTTGCAAAAAGCTTTGCAAAGATG
GATAAAGTTTTAAACAGAGAGGAATCTTTGCAGCTAATGGACCTTCTAGGT
CTTGAAAGGAGTGGGAATTGGCTCCGGTGCCCGTCAGTGGGCAGAGCGCAC
ATCGCCCACAGTCCCCGAGAAGTTGGGGGGAGGGGTCGGCAATTGAACCGG
TGCCTAGAGAAGGTGGCGCGGGGTAAACTGGGAAAGTGATGTCGTGTACTG
GCTCCGCCTTTTTCCCGAGGGTGGGGGAGAACCGTATATAAGTGCAGTAGT
CGCCGTGAACGTTCTTTTTCGCAACGGGTTTGCCGCCAGAACACAGGTAAG
TGCCGTGTGTGGTTCCCGCGGGCCTGGCCTCTTTACGGGTTATGGCCCTTG
CGTGCCTTGAATTACTTCCACCTGGCTGCAGTACGTGATTCTTGATCCCGA
GCTTCGGGTTGGAAGTGGGTGGGAGAGTTCGAGGCCTTGCGCTTAAGGAGC
CCCTTCGCCTCGTGCTTGAGTTGAGGCCTGGCCTGGGCGCTGGGGCCGCCG
CGTGCGAATCTGGTGGCACCTTCGCGCCTGTCTCGCTGCTTTCGATAAGTC
TCTAGCCATTTAAAATTTTTGATGACCTGCTGCGACGCTTTTTTTCTGGCA
AGATAGTCTTGTAAATGCGGGCCAAGATCTGCACACTGGTATTTCGGTTTT
TGGGGCCGCGGGCGGCGACGGGGCCCGTGCGTCCCAGCGCACATGTTCGGC
GAGGCGGGGCCTGCGAGCGCGGCCACCGAGAATCGGACGGGGGTAGTCTCA
AGCTGGCCGGCCTGCTCTGGTGCCTGGCCTCGCGCCGCCGTGTATCGCCCC
GCCCTGGGCGGCAAGGCTGGCCCGGTCGGCACCAGTTGCGTGAGCGGAAAG
ATGGCCGCTTCCCGGCCCTGCTGCAGGGAGCTCAAAATGGAGGACGCGGCG
CTCGGGAGAGCGGGCGGGTGAGTCACCCACACAAAGGAAAAGGGCCTTTCC
GTCCTCAGCCGTCGCTTCATGTGACTCCACGGAGTACCGGGCGCCGTCCAG
GCACCTCGATTAGTTCTCGAGCTTTTGGAGTACGTCGTCTTTAGGTTGGGG
GGAGGGGTTTTATGCGATGGAGTTTCCCCACACTGAGTGGGTGGAGACTGA
AGTTAGGCCAGCTTGGCACTTGATGTAATTCTCCTTGGAATTTGCCCTTTT
TGAGTTTGGATCTTGGTTCATTCTCAAGCCTCAGACAGTGGTTCAAAGTTT
TTTTCTTCCATTTCAGGTGTCGTGAGGAATTCTCTAGAGATCCCTCGACCT
CGAGATCCATTGTGCCCGGGCGCCACCATGGACATGCGCGTGCCCGCCCAG
CTGCTGGGCCTGCTGCTGCTGTGGTTCCCCGGCTCGCGATGC |
| V7 | 872 | GCGTCGACCAAGGGCCCATCGGTCTTCCCCCTGGCACCCTCCTCCAAGAGC
ACCTCTGGGGGCACAGCGGCCCTGGGCTGCCTGGTCAAGGACTACTTCCCC
GAACCGGTGACGGTGTCGTGGAACTCAGGCGCCCTGACCAGCGGCGTGCAC
ACCTTCCCGGCTGTCCTACAGTCCTCAGGACTCTACTCCCTCAGCAGCGTG
GTGACCGTGCCCTCCAGCAGCTTGGGCACCCAGACCTACATCTGCAACGTG
AATCACAAGCCCAGCAACACCAAGGTGGACAAGAAAGTTGAGCCCAAATCT
TGTGACAAAACTCACACATGCCCACCGTGCCCAGCACCTGAAGCCGCGGGG
GGACCGTCAGTCTTCCTCTTCCCCCCAAAACCCAAGGACACCCTCATGATC
TCCCGGACCCCTGAGGTCACATGCGTGGTGGTGGACGTGAGCCACGAAGAC
CCTGAGGTCAAGTTCAACTGGTACGTGGACGGCGTGGAGGTGCATAATGCC
AAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGC
AAGGTCTCCAACAAAGCCCTCCCAGCCCCCATCGAGAAAACCATCTCCAAA
GCCAAAGGGCAGCCCCGAGAACCACAGGTGTACACCCTGCCCCCATCCCGG
GAGGAGATGACCAAGAACCAGGTCAGCCTGACCTGCCTGGTCAAAGGCTTC
TATCCCAGCGACATCGCCGTGGAGTGGGAGAGCAATGGGCAGCCGGAGAAC
AACTACAAGACCACGCCTCCCGTGCTGGACTCCGACGGCTCCTTCTTCCTC
TACAGCAAGCTCACCGTGGACAAGAGCAGGTGGCAGCAGGGGAACGTCTTC
TCATGCTCCGTGATGCATGAGGCTCTGCACAACCACTACACGCAGAAGAGC
CTCTCCCTGTCTCCGGGTAAATGAGCGGCCGCTCGAGGCCGGCAAGGCCGG
ATCCCCCGACCTCGACCTCTGGCTAATAAAGGAAATTTATTTTCATTGCAA
TAGTGTGTTGGAATTTTTTGTGTCTCTCACTCGGAAGGACATATGGGAGGG
CAAATCATTTGGTCGAGATCCCTCGGAGATCTCTAGCTAGAGGATCGATCC
CCGCCCCGGACGAACTAAACCTGACTACGACATCTCTGCCCCTTCTTCGCG
GGGCAGTGCATGTAATCCCTTCAGTTGGTTGGTACAACTTGCCAACTGGGC
CCTGTTCCACATGTGACACGGGGGGGACCCAAACACAAAGGGGTTCTCTGA
CTGTAGTTGACATCCTTATAAATGGATGTGCACATTTGCCAACACTGAGTG
GCTTTCATCCTGGAGCAGACTTTGCAGTCTGTGGACTGCAACACAACATTG
CCTTTATGTGTAACTCTTGGCTGAAGCTCTTACACCAATGCTGGGGGACAT
GTACCTCCCAGGGGCCCAGGAAGACTACGGGAGGCTACACCAACGTCAATC
AGAGGGGCCTGTGTAGCTACCGATAAGCGGACCCTCAAGAGGGCATTAGCA
ATAGTGTTTATAAGGCCCCCTTGTTAACCCTAAACGGGTAGCATATGCTTC
CCGGGTAGTAGTATATACTATCCAGACTAACCCTAATTCAATAGCATATGT
TACCCAACGGGAAGCATATGCTATCGAATTAGGGTTAGTAAAAGGGTCCTA
AGGAACAGCGATATCTCCCACCCCATGAGCTGTCACGTTTTATTTACATG
GGGTCAGGATTCCACGAGGGTAGTGAACCATTTTAGTCACAAGGGCAGTGG
CTGAAGATCAAGGAGCGGGCAGTGAACTCTCCTGAATCTTCGCCTGCTTCT
TCATTCTCCTTCGTTTAGCTAATAGAATAACTGCTGAGTTGTGAACAGTAA
GGTCTATGTGAGGTGCTCGAAAACAAGGTTTCAGGTGACGCCCCAGAATA
AAATTTGGACGGGGGGTTCAGTGGTGGCATTGTGCTATGACACCAATATAA |

TABLE 226-continued

| Vector name | SEQ ID NO | Nucleotide sequences 12345678901234567890123456789012345678901234567 8901 |
|---|---|---|
| | | CCCTCACAAACCCCTTGGGCAATAAATACTAGTGTAGGAATGAAACATTCT
GAATATCTTTAACAATAGAAATCCATGGGGTGGGGACAAGCCGTAAAGACT
GGATGTCCATCTCACACGAATTTATGGCTATGGGCAACACATAATCCTAGT
GCAATATGATACTGGGGTTATTAAGATGTGTCCCAGGCAGGGACCAAGACA
GGTGAACCATGTTGTTACACTCTATTTGTAACAAGGGGAAAGAGAGTGGAC
GCCGACAGCAGCGGACTCCACTGGTTGTCTCTAACACCCCCGAAAATTAAA
CGGGGCTCCACGCCAATGGGGCCCATAAACAAAGACAAGTGGCCACTCTTT
TTTTTGAAATTGTGGAGTGGGGGCACGCGTCAGCCCCCACACGCCGCCCTG
CGGTTTTGGACTGTAAAATAAGGGTGTAATAACTTGGCTGATTGTAACCCC
GCTAACCACTGCGGTCAAACCACTTGCCCACAAAACCACTAATGGCACCCC
GGGGAATACCTGCATAAGTAGGTGGGCGGGCCAAGATAGGGGCGCGATTGC
TGCGATCTGGAGGACAAATTACACACACTTGCGCCTGAGCGCCAAGCACAG
GGTTGTTGGTCCTCATATTCACGAGGTCGCTGAGAGCACGGTGGGCTAATG
TTGCCATGGGTAGCATATACTACCCAAATATCTGGATAGCATATGCTATCC
TAATCTATATCTGGGTAGCATAGGCTATCCTAATCTATATCTGGGTAGCAT
ATGCTATCCTAATCTATATCTGGGTAGTATATGCTATCCTAATTTATATCT
GGGTAGCATAGGCTATCCTAATCTATATCTGGGTAGCATATGCTATCCTAA
TCTATATCTGGGTAGTATATGCTATCCTAATCTGTATCCGGGTAGCATATG
CTATCCTAATAGAGATTAGGGTAGTATATGCTATCCTAATTTATATCTGGG
TAGCATATACTACCCAAATATCTGGATAGCATATGCTATCCTAATCTATAT
CTGGGTAGCATATGCTATCCTAATCTATATCTGGGTAGCATAGGCTATCCT
AATCTATATCTGGGTAGCATATGCTATCCTAATCTATATCTGGGTAGTATA
TGCTATCCTAATTTATATCTGGGTAGCATAGGCTATCCTAATCTATATCTG
GGTAGCATATGCTATCCTAATCTATATCTGGGTAGTATATGCTATCCTAAT
CTGTATCCGGGTAGCATATGCTATCCTCATGATAAGCTGTCAAACATGAGA
ATTTTCTTGAAGACGAAAGGGCCTCGTGATACGCCTATTTTTATAGGTTAA
TGTCATGATAATAATGGTTTCTTAGACGTCAGGTGGCACTTTTCGGGGAAA
TGTGCGCGGAACCCCTATTTGTTTATTTTTCTAAATACATTCAAATATGTA
TCCGCTCATGAGACAATAACCCTGATAAATGCTTCAATAATATTGAAAAAG
GAAGAGTATGAGTATTCAACATTTCCGTGTCGCCCTTATTCCCTTTTTTGC
GGCATTTTGCCTTCCTGTTTTTGCTCACCCAGAAACGCTGGTGAAAGTAAA
AGATGCTGAAGATCAGTTGGGTGCACGAGTGGGTTACATCGAACTGGATCT
CAACAGCGGTAAGATCCTTGAGAGTTTTCGCCCCGAAGAACGTTTTCCAAT
GATGAGCACTTTTAAAGTTCTGCTATGTGGCGCGGTATTATCCCGTGTTGA
CGCCGGGCAAGAGCAACTCGGTCGCCGCATACACTATTCTCAGAATGACTT
GGTTGAGTACTCACCAGTCACAGAAAAGCATCTTACGGATGGCATGACAGT
AAGAGAATTATGCAGTGCTGCCATAACCATGAGTGATAACACTGCGGCCAA
CTTACTTCTGACAACGATCGGAGGACCGAAGGAGCTAACCGCTTTTTTGCA
CAACATGGGGGATCATGTAACTCGCCTTGATCGTTGGGAACCGGAGCTGAA
TGAAGCCATACCAAACGACGAGCGTGACACCACGATGCCTGCAGCAATGGC
AACAACGTTGCGCAAACTATTAACTGGCGAACTACTTACTCTAGCTTCCCG
GCAACAATTAATAGACTGGATGGAGGCGGATAAAGTTGCAGGACCACTTCT
GCGCTCGGCCCTTCCGGCTGGCTGGTTTATTGCTGATAAATCTGGAGCCGG
TGAGCGTGGGTCTCGCGGTATCATTGCAGCACTGGGGCCAGATGGTAAGCC
CTCCCGTATCGTAGTTATCTACACGACGGGGAGTCAGGCAACTATGGATGA
ACGAAATAGACAGATCGCTGAGATAGGTGCCTCACTGATTAAGCATTGGTA
ACTGTCAGACCAAGTTTACTCATATATACTTTAGATTGATTTAAAACTTCA
TTTTTAATTTAAAAGGATCTAGGTGAAGATCCTTTTTGATAATCTCATGAC
CAAAATCCCTTAACGTGAGTTTTCGTTCCACTGAGCGTCAGACCCCGTAGA
AAAGATCAAAGGATCTTCTTGAGATCCTTTTTTTCTGCGCGTAATCTGCTG
CTTGCAAACAAAAAAACCACCGCTACCAGCGGTGGTTTGTTTGCCGGATCA
AGAGCTACCAACTCTTTTTCCGAAGGTAACTGGCTTCAGCAGAGCGCAGAT
ACCAAATACTGTTCTTCTAGTGTAGCCGTAGTTAGGCCACCACTTCAAGAA
CTCTGTAGCACCGCCTACATACCTCGCTCTGCTAATCCTGTTACCAGTGGC
TGCTGCCAGTGGCGATAAGTCGTGTCTTACCGGGTTGGACTCAAGACGATA
GTTACCGGATAAGGCGCAGCGGTCGGGCTGAACGGGGGGTTCGTGCACACA
GCCCAGCTTGGAGCGAACGACCTACACCGAACTGAGATACCTACAGCGTGA
GCTATGAGAAAGCGCCACGCTTCCCGAAGGGAGAAAGGCGGACAGGTATCC
GGTAAGCGGCAGGGTCGGAACAGGAGAGCGCACGAGGGAGCTTCCAGGGGG
AAACGCCTGGTATCTTTATAGTCCTGTCGGGTTTCGCCACCTCTGACTTGA
GCGTCGATTTTTGTGATGCTCGTCAGGGGGCGGAGCCTATGGAAAAACGC
CAGCAACGCGGCCTTTTTACGGTTCCTGGCCTTTTGCTGGCCTTTTGCTCA
CATGTTCTTTCCTGCGTTATCCCCTGATTCTGTGGATAACCGTATTACCGC
CTTTGAGTGAGCTGATACCGCTCGCCGCAGCCGAACGACCGAGCGCAGCGA
GTCAGTGAGCGAGGAAGCGGAAGAGCGCCCAATACGCAAACCGCCTCTCCC
CGCGCGTTGGCCGATTCATTAATGCAGCTGGCACGACAGGTTTCCCGACTG
GAAAGCGGGCAGTGAGCGCAACGCAATTAATGTGAGTTAGCTCACTCATTA
GGCACCCCAGGCTTTACACTTTATGCTTCCGGCTCGTATGTTGTGTGGAAT
TGTGAGCGGATAACAATTTCACACAGGAAACAGCTATGACCATGATTACGC
CAAGCTCTAGCTAGAGGTCGAGTCCCTCCCCAGCAGGCAGAAGTATGCAAA
GCATGCATCTCAATTAGTCAGCAACCATAGTCCCGCCCCTAACTCCGCCCA
TCCCGCCCCTAACTCCGCCCAGTTCCGCCCATTCTCCGCCCCATGGCTGAC
TAATTTTTTTTATTTATGCAGAGGCCGAGGCCGCCTCGGCCTCTGAGCTAT
TCCAGAAGTAGTGAGGAGGCTTTTTTGGAGGCCTAGGCTTTTGCAAAAAGC
TTTGCAAAGATGGATAAAGTTTTAAACAGAGAGGAATCTTTGCAGCTAATG
GACCTTCTAGGTCTTGAAAGGAGTGGGAATTGGCTCCGGTGCCCGTCAGTG
GGCAGAGCGCACATCGCCCACAGTCCCCGAGAAGTTGGGGGGAGGGGTCGG |

TABLE 226-continued

| Vector name | SEQ ID NO | Nucleotide sequences 1234567890123456789012345678901234567890123456789012345678901 |
|---|---|---|
| | | CAATTGAACCGGTGCCTAGAGAAGGTGGCGCGGGGTAAACTGGGAAAGTGA |
| | | TGTCGTGTACTGGCTCCGCCTTTTTCCCGAGGGTGGGGGAGAACCGTATAT |
| | | AAGTGCAGTAGTCGCCGTGAACGTTCTTTTTCGCAACGGGTTTGCCGCCAG |
| | | AACACAGGTAAGTGCCGTGTGTGGTTCCCGCGGGCCTGGCCTCTTTACGGG |
| | | TTATGGCCCTTGCGTGCCTTGAATTACTTCCACCTGGCTGCAGTACGTGAT |
| | | TCTTGATCCCGAGCTTCGGGTTGGAAGTGGGTGGGAGAGTTCGAGGCCTTG |
| | | CGCTTAAGGAGCCCCTTCGCCTCGTGCTTGAGTTGAGGCCTGGCCTGGGCG |
| | | CTGGGGCCGCCGCGTGCGAATCTGGTGGCACCTTCGCGCCTGTCTCGCTGC |
| | | TTTCGATAAGTCTCTAGCCATTTAAAATTTTTGATGACCTGCTGCGACGCT |
| | | TTTTTTCTGGCAAGATAGTCTTGTAAATGCGGGCCAAGATCTGCACACTGG |
| | | TATTTCGGTTTTTGGGGCCGCGGGCGGCGACGGGGCCCGTGCGTCCCAGCG |
| | | CACATGTTCGGCGAGGCGGGGCCTGCGAGCGCGGCCACCGAGAATCGGACG |
| | | GGGGTAGTCTCAAGCTGGCCGGCCTGCTCTGGTGCCTGGCCTCGCGCCGCC |
| | | GTGTATCGCCCCGCCCTGGGCGGCAAGGCTGGCCCGGTCGGCACCAGTTGC |
| | | GTGAGCGGAAAGATGGCCGCTTCCCGGCCCTGCTGCAGGGAGCTCAAAATG |
| | | GAGGACGCGGCGCTCGGGAGAGCGGGCGGGTGAGTCACCCACACAAAGGAA |
| | | AAGGGCCTTTCCGTCCTCAGCCGTCGCTTCATGTGACTCCACGGAGTACCG |
| | | GGCGCCGTCCAGGCACCTCGATTAGTTCTCGAGCTTTTGGAGTACGTCGTC |
| | | TTTAGGTTGGGGGAGGGGTTTTATGCGATGGAGTTTCCCCACACTGAGTG |
| | | GGTGGAGACTGAAGTTAGGCCAGCTTGGCACTTGATGTAATTCTCCTTGGA |
| | | ATTTGCCCTTTTTGAGTTTGGATCTTGGTTCATTCTCAAGCCTCAGACAGT |
| | | GGTTCAAAGTTTTTTCTTCCATTTCAGGTGTCGTGAGGAATTCTCTAGAG |
| | | ATCCCTCGACCTCGAGATCCATTGTGCCCGGGCGCCACCATGGAGTTTGGG |
| | | CTGAGCTGGCTTTTCTTGTCGCGATTTTAAAAGGTGTCCAGTGC |

The present invention incorporates by reference in their entirety techniques well known in the field of molecular biology and drug delivery. These techniques include, but are not limited to, techniques described in the following publications:

Ausubel et al. (eds.), *Current Protocols in Molecular Biology*, John Wiley &Sons, NY (1993);

Ausubel, F. M. et al. eds., *Short Protocols In Molecular Biology* (4th Ed. 1999) John Wiley & Sons, NY. (ISBN 0-471-32938-X).

*Controlled Drug Bioavailability, Drug Product Design and Performance*, Smolen and Ball (eds.), Wiley, New York (1984);

Giege, R. and Ducruix, A. Barrett, *Crystallization of Nucleic Acids and Proteins*, a Practical Approach, 2nd ea., pp. 20 1-16, Oxford University Press, New York, N.Y., (1999);

Goodson, in *Medical Applications of Controlled Release*, vol. 2, pp. 115-138 (1984);

Hammerling, et al., in: *Monoclonal Antibodies and T-Cell Hybridomas* 563-681 (Elsevier, N.Y., 1981;

Harlow et al., *Antibodies: A Laboratory Manual*, (Cold Spring Harbor Laboratory Press, 2nd ed. 1988);

Kabat et al., *Sequences of Proteins of Immunological Interest* (National Institutes of Health, Bethesda, Md. (1987) and (1991);

Kabat, E. A., et al. (1991) *Sequences of Proteins of Immunological Interest*, Fifth Edition, U.S. Department of Health and Human Services, NIH Publication No. 91-3242;

Kontermann and Dubel eds., *Antibody Engineering* (2001) Springer-Verlag. New York. 790 pp. (ISBN 3-540-41354-5).

Kriegler, Gene Transfer and Expression, A Laboratory Manual, Stockton Press, NY (1990);

Lu and Weiner eds., *Cloning and Expression Vectors for Gene Function Analysis* (2001) BioTechniques Press. Westborough, Mass. 298 pp. (ISBN 1-881299-21-X).

*Medical Applications of Controlled Release*, Langer and Wise (eds.), CRC Pres., Boca Raton, Fla. (1974);

Old, R. W. & S. B. Primrose, *Principles of Gene Manipulation: An Introduction To Genetic Engineering* (3d Ed. 1985) Blackwell Scientific Publications, Boston. Studies in Microbiology; V.2:409 pp. (ISBN 0-632-01318-4).

Sambrook, J. et al. eds., *Molecular Cloning: A Laboratory Manual* (2d Ed. 1989) Cold Spring Harbor Laboratory Press, NY. Vols. 1-3. (ISBN 0-87969-309-6).

*Sustained and Controlled Release Drug Delivery Systems*, J. R. Robinson, ed., Marcel Dekker, Inc., New York, 1978

Winnacker, E. L. *From Genes To Clones: Introduction To Gene Technology* (1987) VCH Publishers, NY (translated by Horst Ibelgaufts). 634 pp. (ISBN 0-89573-614-4).

INCORPORATION BY REFERENCE

The contents of all cited references (including literature references, patents, patent applications, and websites) that may be cited throughout this application are hereby expressly incorporated by reference in their entirety, as are the references cited therein. The practice of the present invention will employ, unless otherwise indicated, conventional techniques of immunology, molecular biology and cell biology, which are well known in the art.

EQUIVALENTS

The invention may be embodied in other specific forms without departing from the spirit or essential characteristics thereof. The foregoing embodiments are therefore to be considered in all respects illustrative rather than limiting of the invention described herein. Scope of the invention is thus indicated by the appended claims rather than by the foregoing description, and all changes that come within the meaning and range of equivalency of the claims are therefore intended to be embraced herein.

SEQUENCE LISTING (873 sequences)

SEQ ID NO: 1 - protein, 16 aa, Artificial Sequence
  Description of Artificial Sequence: Synthetic peptide
AKTTPKLEEGEFSEAR

SEQ ID NO: 2 - protein, 17 aa, Artificial Sequence
  Description of Artificial Sequence: Synthetic peptide
AKTTPKLEEGEFSEARV

SEQ ID NO: 3 - protein, 9 aa, Artificial Sequence
  Description of Artificial Sequence: Synthetic peptide
AKTTPKLGG

SEQ ID NO: 4 - protein, 10 aa, Artificial Sequence
  Description of Artificial Sequence: Synthetic peptide
SAKTTPKLGG

SEQ ID NO: 5 - protein, 6 aa, Artificial Sequence
  Description of Artificial Sequence: Synthetic peptide
SAKTTP

SEQ ID NO: 6 - protein, 6 aa, Artificial Sequence
  Description of Artificial Sequence: Synthetic peptide
RADAAP

SEQ ID NO: 7 - protein, 9 aa, Artificial Sequence
  Description of Artificial Sequence: Synthetic peptide
RADAAPTVS

SEQ ID NO: 8 - protein, 12 aa, Artificial Sequence
  Description of Artificial Sequence: Synthetic peptide
RADAAAAGGPGS

SEQ ID NO: 9 - protein, 27 aa, Artificial Sequence
  Description of Artificial Sequence: Synthetic peptide
RADAAAAGGGGSGGGGSGGGGSGGGGS

SEQ ID NO: 10 - protein, 18 aa, Artificial Sequence
  Description of Artificial Sequence: Synthetic peptide
SAKTTPKLEEGEFSEARV

SEQ ID NO: 11 - protein, 5 aa, Artificial Sequence
  Description of Artificial Sequence: Synthetic peptide
ADAAP

SEQ ID NO: 12 - protein, 12 aa, Artificial Sequence
  Description of Artificial Sequence: Synthetic peptide
ADAAPTVSIFPP

SEQ ID NO: 13 - protein, 5 aa, Artificial Sequence
  Description of Artificial Sequence: Synthetic peptide
TVAAP

SEQ ID NO: 14 - protein, 12 aa, Artificial Sequence
  Description of Artificial Sequence: Synthetic peptide
TVAAPSVFIFPP

SEQ ID NO: 15 - protein, 6 aa, Artificial Sequence
  Description of Artificial Sequence: Synthetic peptide
QPKAAP

SEQ ID NO: 16 - protein, 13 aa, Artificial Sequence
  Description of Artificial Sequence: Synthetic peptide
QPKAAPSVTLFPP

SEQ ID NO: 17 - protein, 6 aa, Artificial Sequence
  Description of Artificial Sequence: Synthetic peptide
AKTTPP

SEQ ID NO: 18 - protein, 13 aa, Artificial Sequence
  Description of Artificial Sequence: Synthetic peptide
AKTTPPSVTPLAP

SEQ ID NO: 19 - protein, 6 aa, Artificial Sequence
  Description of Artificial Sequence: Synthetic peptide
AKTTAP

SEQ ID NO: 20 - protein, 13 aa, Artificial Sequence
  Description of Artificial Sequence: Synthetic peptide
AKTTAPSVYPLAP

SEQ ID NO: 21 - protein, 6 aa, Artificial Sequence
  Description of Artificial Sequence: Synthetic peptide
ASTKGP

SEQ ID NO: 22 - protein, 13 aa, Artificial Sequence
  Description of Artificial Sequence: Synthetic peptide
ASTKGPSVFPLAP

SEQ ID NO: 23 - protein, 15 aa, Artificial Sequence
  Description of Artificial Sequence: Synthetic peptide
GGGGSGGGGSGGGGS

SEQ ID NO: 24 - protein, 15 aa, Artificial Sequence
  Description of Artificial Sequence: Synthetic peptide
GENKVEYAPALMALS

SEQ ID NO: 25 - protein, 15 aa, Artificial Sequence
  Description of Artificial Sequence: Synthetic peptide
GPAKELTPLKEAKVS

SEQ ID NO: 26 - protein, 15 aa, Artificial Sequence
  Description of Artificial Sequence: Synthetic peptide
GHEAAAVMQVQYPAS

SEQ ID NO: 27 - protein, 121 aa, Artificial Sequence [sequence omitted]

SEQ ID NO: 28 - protein, 107 aa, Artificial Sequence
  Description of Artificial Sequence: Synthetic polypeptide
QIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKR

SEQ ID NO: 29 - protein, 119 aa, Artificial Sequence [sequence omitted]

SEQ ID NO: 30 - protein, 107 aa, Artificial Sequence
  Description of Artificial Sequence: Synthetic polypeptide
QIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINR

SEQ ID NO: 31 - protein, 119 aa, Artificial Sequence [sequence omitted]

SEQ ID NO: 32 - protein, 108 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 33 - protein, 120 aa, Artificial Sequence [sequence omitted]

SEQ ID NO: 34 - protein, 108 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 35 - protein, 124 aa, Artificial Sequence
  Description of Artificial Sequence: Synthetic polypeptide
EVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSS

SEQ ID NO: 36 - protein, 114 aa, Artificial Sequence
  Description of Artificial Sequence: Synthetic polypeptide
DVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRR

SEQ ID NO: 37 - protein, 124 aa, Artificial Sequence
  Description of Artificial Sequence: Synthetic polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSS

SEQ ID NO: 38 - protein, 112 aa, Artificial Sequence
  Description of Artificial Sequence: Synthetic polypeptide
DILLTQTPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKR

SEQ ID NO: 39 - protein, 127 aa, Artificial Sequence [sequence omitted]

SEQ ID NO: 40 - protein, 111 aa, Artificial Sequence
  Description of Artificial Sequence: Synthetic polypeptide
ESALTQPPSVSGAPGQKVTISCTGSTSNIGGYDLHWYQQLPGTAPKLLIYDINKRPSGISDRFSGSKSGTAASLAITGLQTEDEADYYCQSYDSSLNAQVFGGGTRLTVLG

SEQ ID NO: 41 - protein, 116 aa, Artificial Sequence [sequence omitted]

SEQ ID NO: 42 - protein, 113 aa, Artificial Sequence
  Description of Artificial Sequence: Synthetic polypeptide
DIQLTQSPSSLSASVGDRVTMSCKSSQSVLYSANHKNYLAWYQQKPGKAPKLLIYWASTRESGVPSRFSGSGSGTDFTFTISSLQPEDIATYYCHQYLSSWTFGGGTKLEIKR

SEQ ID NO: 43 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSS

SEQ ID NO: 44 - protein, 113 aa, Artificial Sequence
  Description of Artificial Sequence: Synthetic polypeptide
DIVMTQSPLSLTVTPGEPASISCRSSQSLLYSNGYNYLDWYLQKPGQSPQVLISLGSNRASGVPDRFSGSGSGTDFTLKISRVEAEDVGVYYCMQARQTPFTFGPGTKVDIRR

SEQ ID NO: 45 - protein, 120 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSS

SEQ ID NO: 46 - protein, 112 aa, Artificial Sequence
  Description of Artificial Sequence: Synthetic polypeptide
QSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLG

SEQ ID NO: 47 - protein, 125 aa, Artificial Sequence [sequence omitted]

SEQ ID NO: 48 - protein, 108 aa, Artificial Sequence
  Description of Artificial Sequence: Synthetic polypeptide
DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKR

SEQ ID NO: 49 - protein, 122 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 50 - protein, 108 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 51 - protein, 121 aa, Artificial Sequence
  Description of Artificial Sequence: Synthetic polypeptide
QVQLQQSGPELVRPGASVKWSCPASGYTFTSYWLHWVKKQRPGQGLEWIGMIDPSNSDTRFNPPNFKDKATLNVDRSSNTAYNLLSSLTSADSAVYYCATYGSYVSPLDYWGQGTSVYVSS

SEQ ID NO: 52 - protein, 114 aa, Artificial Sequence
  Description of Artificial Sequence: Synthetic polypeptide
DIMMSQSPSSLTVSVGEKVTVSCKSSQSLLVTSSQKNYLAWYQQKPQQSPKLLIYWASTRESGVPDRFTGSGSGTDFTLTITSVKADDLAVYYCQQYYAYPWTFGDGTKLEIKR

SEQ ID NO: 53 - protein, 123 aa, Artificial Sequence [sequence omitted]

SEQ ID NO: 54 - protein, 108 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 55 - protein, 118 aa, Artificial Sequence
  Description of Artificial Sequence: Synthetic polypeptide
EVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSS

SEQ ID NO: 56 - protein, 109 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKR

SEQ ID NO: 57 - protein, 119 aa, Artificial Sequence
  Description of Artificial Sequence: Synthetic polypeptide
EVQLVESGGGLVQPGGSLRLSCAASGFSFSSEPISWVRQAPGKGLEWVSSITGKNGYTYYADSVKGRFTISADTSKNTAYLQMNSLRAEDTAVYYCARWGKKVYGMDVWGQGTLVTVSS

SEQ ID NO: 58 - protein, 108 aa, Artificial Sequence
  Description of Artificial Sequence: Synthetic polypeptide
DIQMTQSPSSLSASVGDRVTITCRASQSISSYLAWYQQKPGKAPKLLIYGASSRASGVPSRFSGSGSGTDFTLTISSLQPEDFATYYCQQYMSVPITFGQGTKVEIKR

SEQ ID NO: 59 - protein, 119 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 60 - protein, 108 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 61 - protein, 127 aa, Artificial Sequence
  Description of Artificial Sequence: Synthetic polypeptide
QVQLQESGPGLVKPSEILSLTCTVSGGSISSHYWSWVRQPPGKGLEWIGYIYYSGSTNYNPSLKSRVTISVDTSKNQFSLNLSSVTAADTAVYYCARIPNYYDRSGYYPGYWYFDLWGRGTLVTVSS

SEQ ID NO: 62 - protein, 116 aa, Artificial Sequence
  Description of Artificial Sequence: Synthetic polypeptide
QAVLTQPSSLSAPPGASASLTCTLRSGFNVDSYRISWYQQKPGSPPQYLLRYKSDSDKQQGSGVPSRFSGSKDASANAGILLISGLQSEDEADYYCMIWHSSAWVFGGGTKLTVLR

SEQ ID NO: 63 - protein, 122 aa, Artificial Sequence
  Description of Artificial Sequence: Synthetic polypeptide
EVQLVESGGGLVQPGGSLRLSCAASGFTFSSYAMSWVRQAPGKGLEWVSQISPAGGYTNYADSVKGRFTISADTSKNTAYLQMNSLRAEDTAVYYCARELPYYRMSKVMDVQGQGTLVTVSS

SEQ ID NO: 64 - protein, 108 aa, Artificial Sequence [sequence omitted]

SEQ ID NO: 65 - protein, 119 aa, Artificial Sequence [sequence omitted]

SEQ ID NO: 66 - protein, 107 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 67 - protein, 116 aa, Artificial Sequence
  Description of Artificial Sequence: Synthetic polypeptide
QVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSS

SEQ ID NO: 68 - protein, 113 aa, Artificial Sequence
  Description of Artificial Sequence: Synthetic polypeptide
DIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKR

SEQ ID NO: 69 - protein, 117 aa, Artificial Sequence [sequence omitted]

SEQ ID NO: 70 - protein, 114 aa, Artificial Sequence
  Description of Artificial Sequence: Synthetic polypeptide
DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKR

SEQ ID NO: 71 - protein, 119 aa, Artificial Sequence
  Description of Artificial Sequence: Synthetic polypeptide
EVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSS

SEQ ID NO: 72 - protein, 108 aa, Artificial Sequence
  Description of Artificial Sequence: Synthetic polypeptide
DIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKR

SEQ ID NO: 73 - protein, 119 aa, Artificial Sequence [sequence omitted]

SEQ ID NO: 74 - protein, 112 aa, Artificial Sequence
  Description of Artificial Sequence: Synthetic polypeptide
QSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLG

SEQ ID NO: 75 - protein, 119 aa, Artificial Sequence
  Description of Artificial Sequence: Synthetic polypeptide
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSS

SEQ ID NO: 76 - protein, 112 aa, Artificial Sequence
  Description of Artificial Sequence: Synthetic polypeptide
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKR

SEQ ID NO: 77 - protein, 120 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 78 - protein, 108 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 79 - protein, 121 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 80 - protein, 108 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 81 - protein, 120 aa, Artificial Sequence
  Description of Artificial Sequence: Synthetic polypeptide
EVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSS

SEQ ID NO: 82 - protein, 108 aa, Artificial Sequence
  Description of Artificial Sequence: Synthetic polypeptide
DIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKR

SEQ ID NO: 83 - protein, 120 aa, Artificial Sequence
  Description of Artificial Sequence: Synthetic polypeptide
EVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSS

SEQ ID NO: 84 - protein, 110 aa, Artificial Sequence
  Description of Artificial Sequence: Synthetic polypeptide
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 85 - protein, 116 aa, Artificial Sequence
  Description of Artificial Sequence: Synthetic polypeptide
QVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSS

SEQ ID NO: 86 - protein, 108 aa, Artificial Sequence
  Description of Artificial Sequence: Synthetic polypeptide
AIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKR

SEQ ID NO: 87 - protein, 130 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSS

SEQ ID NO: 88 - protein, 109 aa, Artificial Sequence
  Description of Artificial Sequence: Synthetic polypeptide
SSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLG

SEQ ID NO: 89 - protein, 118 aa, Artificial Sequence [sequence omitted]

SEQ ID NO: 90 - protein, 108 aa, Artificial Sequence
  Description of Artificial Sequence: Synthetic polypeptide
EIVLTQSPGTLSVSPGERATLSCRASQSIGSSLHWYQQKPGQAPRLLIKYASQSLSGIPDRFSGSGSGTDFTLTISRLEPEDFAVYYCHQSSRLPHTFGQGTKVEIKR

SEQ ID NO: 91 - protein, 118 aa, Artificial Sequence
  Description of Artificial Sequence: Synthetic polypeptide
EVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSS

SEQ ID NO: 92 - protein, 108 aa, Artificial Sequence
  Description of Artificial Sequence: Synthetic polypeptide
DIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKR

SEQ ID NO: 93 - protein, 119 aa, Artificial Sequence [sequence omitted]

SEQ ID NO: 94 - protein, 108 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKR

SEQ ID NO: 95 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 98 - protein, 105 aa, Homo sapiens
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 99 - protein, 251 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSS

SEQ ID NO: 100 - protein, 224 aa, Artificial Sequence
  Description of Artificial Sequence: Synthetic polypeptide
QIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPDILLTQTPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKR

SEQ ID NO: 101 - protein, 251 aa, Artificial Sequence
  Description of Artificial Sequence: Synthetic polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSSASTKGPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSA

SEQ ID NO: 102 - protein, 224 aa, Artificial Sequence
  Description of Artificial Sequence: Synthetic polypeptide
DILLTQTPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKRTVAAPQIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKR

SEQ ID NO: 103 - protein, 246 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 104 - protein, 219 aa, Artificial Sequence
  Description of Artificial Sequence: Synthetic polypeptide
QIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPQIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINR

SEQ ID NO: 105 - protein, 246 aa, Artificial Sequence
  Description of Artificial Sequence: Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSA

SEQ ID NO: 106 - protein, 219 aa, Artificial Sequence
  Description of Artificial Sequence: Synthetic polypeptide
QIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINRTVAAPQIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKR

SEQ ID NO: 107 - protein, 254 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPQVQLQESGPGLVKPSETLSLTCAVSGGSISGGYGWGWIRQPPGKGLEWIGSFYSSSGNTYYNPSLKSQVTISTDTSKNQFSLKLNSMTAADTAVYYCVRDRLFSVVGMVYNNWFDVWGPGVLVTVSS

SEQ ID NO: 108 - protein, 223 aa, Artificial Sequence
  Description of Artificial Sequence: Synthetic polypeptide
QIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPESALTQPPSVSGAPGQKVTISCTGSTSNIGGYDLHWYQQLPGTAPKLLIYDINKRPSGISDRFSGSKSGTAASLAITGLQTEDEADYYCQSYDSSLNAQVFGGGTRLTVLG

SEQ ID NO: 109 - protein, 254 aa, Artificial Sequence
  Description of Artificial Sequence: Synthetic polypeptide
QVQLQESGPGLVKPSETLSLTCAVSGGSISGGYGWGWIRQPPGKGLEWIGSFYSSSGNTYYNPSLKSQVTISTDTSKNQFSLKLNSMTAADTAVYYCVRDRLFSVVGMVYNNWFDVWGPGVLVTVSSASTKGPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSA

SEQ ID NO: 110 - protein, 224 aa, Artificial Sequence
  Description of Artificial Sequence: Synthetic polypeptide
ESALTQPPSVSGAPGQKVTISCTGSTSNIGGYDLHWYQQLPGTAPKLLIYDINKRPSGISDRFSGSKSGTAASLAITGLQTEDEADYYCQSYDSSLNAQVFGGGTRLTVLGQPKAAPQIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKR

SEQ ID NO: 111 - protein, 243 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPQVQLVQSGAEVKKPGSSVKVSCKASGYTFTSYWLHWVRQAPGQGLEWIGYINPRNDYTEYNQNFKDKATITADESTNTAYMELSSLRSEDTAFYFCARRDITTFYWGQGTTVTVSS

SEQ ID NO: 112 - protein, 225 aa, Artificial Sequence
  Description of Artificial Sequence: Synthetic polypeptide
QIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPDIQLTQSPSSLSASVGDRVTMSCKSSQSVLYSANHKNYLAWYQQKPGKAPKLLIYWASTRESGVPSRFSGSGSGTDFTFTISSLQPEDIATYYCHQYLSSWTFGGGTKLEIKR

SEQ ID NO: 113 - protein, 243 aa, Artificial Sequence
  Description of Artificial Sequence: Synthetic polypeptide
QVQLVQSGAEVKKPGSSVKVSCKASGYTFTSYWLHWVRQAPGQGLEWIGYINPRNDYTEYNQNFKDKATITADESTNTAYMELSSLRSEDTAFYFCARRDITTFYWGQGTTVTVSSASTKGPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSA

SEQ ID NO: 114 - protein, 225 aa, Artificial Sequence
  Description of Artificial Sequence: Synthetic polypeptide
DIQLTQSPSSLSASVGDRVTMSCKSSQSVLYSANHKNYLAWYQQKPGKAPKLLIYWASTRESGVPSRFSGSGSGTDFTFTISSLQPEDIATYYCHQYLSSWTFGGGTKLEIKRTVAAPQIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKR

SEQ ID NO: 115 - protein, 247 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPQVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSS

SEQ ID NO: 116 - protein, 225 aa, Artificial Sequence
  Description of Artificial Sequence: Synthetic polypeptide
QIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPDIVMTQSPLSLTVTPGEPASISCRSSQSLLYSNGYNYLDWYLQKPGQSPQVLISLGSNRASGVPDRFSGSGSGTDFTLKISRVEAEDVGVYYCMQARQTPFTFGPGTKVDIRR

SEQ ID NO: 117 - protein, 247 aa, Artificial Sequence
  Description of Artificial Sequence: Synthetic polypeptide
QVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSSASTKGPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSA

SEQ ID NO: 118 - protein, 225 aa, Artificial Sequence
  Description of Artificial Sequence: Synthetic polypeptide
DIVMTQSPLSLTVTPGEPASISCRSSQSLLYSNGYNYLDWYLQKPGQSPQVLISLGSNRASGVPDRFSGSGSGTDFTLKISRVEAEDVGVYYCMQARQTPFTFGPGTKVDIRRTVAAPQIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKR

SEQ ID NO: 119 - protein, 245 aa, Artificial Sequence
  Description of Artificial Sequence: Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 120 - protein, 220 aa, Artificial Sequence
  Description of Artificial Sequence: Synthetic polypeptide
QIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 121 - protein, 245 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 122 - protein, 220 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPQIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINR

SEQ ID NO: 123 - protein, 249 aa, Artificial Sequence
  Description of Artificial Sequence: Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSS

SEQ ID NO: 124 - protein, 224 aa, Artificial Sequence
  Description of Artificial Sequence: Synthetic polypeptide
QIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINRTVAAPDILLTQTPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKR

SEQ ID NO: 125 - protein, 249 aa, Artificial Sequence
  Description of Artificial Sequence: Synthetic polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSSASTKGPQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 126 - protein, 224 aa, Artificial Sequence
  Description of Artificial Sequence: Synthetic polypeptide
DILLTQTPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKRTVAAPQIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINR

SEQ ID NO: 127 - protein, 245 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 128 - protein, 221 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 129 - protein, 245 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 130 - protein, 221 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 131 - protein, 244 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 132 - protein, 220 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPQIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINR

SEQ ID NO: 133 - protein, 244 aa, Artificial Sequence
  Description of Artificial Sequence: Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 134 - protein, 220 aa, Artificial Sequence
  Description of Artificial Sequence: Synthetic polypeptide
QIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 135 - protein, 245 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSS

SEQ ID NO: 136 - protein, 225 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPQSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLG

SEQ ID NO: 137 - protein, 245 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 138 - protein, 226 aa, Artificial Sequence
  Description of Artificial Sequence: Synthetic polypeptide
QSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLGQPKAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 139 - protein, 250 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPEVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSS

SEQ ID NO: 140 - protein, 221 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKR

SEQ ID NO: 141 - protein, 250 aa, Artificial Sequence
  Description of Artificial Sequence: Synthetic polypeptide
EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 142 - protein, 221 aa, Artificial Sequence
  Description of Artificial Sequence: Synthetic polypeptide
DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 143 - protein, 257 aa, Artificial Sequence
  Description of Artificial Sequence: Synthetic polypeptide
EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTKGPSVFPLAPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 144 - protein, 228 aa, Artificial Sequence
  Description of Artificial Sequence: Synthetic polypeptide
DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRTVAAPSVFIFPPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 145 - protein, 257 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPEVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSS

SEQ ID NO: 146 - protein, 228 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPDIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKR

SEQ ID NO: 147 - protein, 257 aa, Artificial Sequence; identical to SEQ ID NO: 143
  Description of Artificial Sequence: Synthetic polypeptide

SEQ ID NO: 148 - protein, 221 aa, Artificial Sequence; identical to SEQ ID NO: 142
  Description of Artificial Sequence: Synthetic polypeptide

SEQ ID NO: 149 - protein, 257 aa, Artificial Sequence; identical to SEQ ID NO: 145
  Description of Artificial Sequence: Synthetic polypeptide

SEQ ID NO: 150 - protein, 221 aa, Artificial Sequence; identical to SEQ ID NO: 140
  Description of Artificial Sequence: Synthetic polypeptide

SEQ ID NO: 151 - protein, 250 aa, Artificial Sequence; identical to SEQ ID NO: 141
  Description of Artificial Sequence: Synthetic polypeptide

SEQ ID NO: 152 - protein, 228 aa, Artificial Sequence; identical to SEQ ID NO: 144
  Description of Artificial Sequence: Synthetic polypeptide

SEQ ID NO: 153 - protein, 250 aa, Artificial Sequence; identical to SEQ ID NO: 139
  Description of Artificial Sequence: Synthetic polypeptide

SEQ ID NO: 154 - protein, 228 aa, Artificial Sequence; identical to SEQ ID NO: 146
  Description of Artificial Sequence: Synthetic polypeptide

SEQ ID NO: 155 - protein, 255 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 156 - protein, 223 aa, Artificial Sequence
  Description of Artificial Sequence: Synthetic polypeptide
SSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLGQPKAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 157 - protein, 255 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSS

SEQ ID NO: 158 - protein, 222 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLG

SEQ ID NO: 159 - protein, 262 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSSASTKGPSVFPLAPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 160 - protein, 230 aa, Artificial Sequence
  Description of Artificial Sequence: Synthetic polypeptide
SSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLGQPKAAPSVTLFPPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 161 - protein, 262 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSS

SEQ ID NO: 162 - protein, 229 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLG

SEQ ID NO: 163 - protein, 262 aa, Artificial Sequence; identical to SEQ ID NO: 159
  Description of Artificial Sequence: Synthetic polypeptide

SEQ ID NO: 164 - protein, 223 aa, Artificial Sequence; identical to SEQ ID NO: 156
  Description of Artificial Sequence: Synthetic polypeptide

SEQ ID NO: 165 - protein, 262 aa, Artificial Sequence; identical to SEQ ID NO: 161
  Description of Artificial Sequence: Synthetic polypeptide

SEQ ID NO: 166 - protein, 222 aa, Artificial Sequence; identical to SEQ ID NO: 158
  Description of Artificial Sequence: Synthetic polypeptide

SEQ ID NO: 167 - protein, 255 aa, Artificial Sequence; identical to SEQ ID NO: 155
  Description of Artificial Sequence: Synthetic polypeptide

SEQ ID NO: 168 - protein, 230 aa, Artificial Sequence; identical to SEQ ID NO: 160
  Description of Artificial Sequence: Synthetic polypeptide

SEQ ID NO: 169 - protein, 255 aa, Artificial Sequence; identical to SEQ ID NO: 157
  Description of Artificial Sequence: Synthetic polypeptide

SEQ ID NO: 170 - protein, 229 aa, Artificial Sequence; identical to SEQ ID NO: 162
  Description of Artificial Sequence: Synthetic polypeptide

SEQ ID NO: 171 - protein, 243 aa, Artificial Sequence
  Description of Artificial Sequence: Synthetic polypeptide
EVQLVQSGGGLVKPGGSLRLSCAASGFTFSSFAMHWVRQAPGKGLEWISVIDTRGATYYADSVKGRFTISRDNAKNSLYLQMNSLRAEDTAVYYCARLGNFYYGMDVWGQGTTVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 172 - protein, 221 aa, Artificial Sequence
  Description of Artificial Sequence: Synthetic polypeptide
EIVLTQSPGTLSVSPGERATLSCRASQSIGSSLHWYQQKPGQAPRLLIKYASQSLSGIPDRFSGSGSGTDFTLTISRLEPEDFAVYYCHQSSRLPHTFGQGTKVEIKRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 173 - protein, 243 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPEVQLVQSGGGLVKPGGSLRLSCAASGFTFSSFAMHWVRQAPGKGLEWISVIDTRGATYYADSVKGRFTISRDNAKNSLYLQMNSLRAEDTAVYYCARLGNFYYGMDVWGQGTTVTVSS

SEQ ID NO: 174 - protein, 221 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPEIVLTQSPGTLSVSPGERATLSCRASQSIGSSLHWYQQKPGQAPRLLIKYASQSLSGIPDRFSGSGSGTDFTLTISRLEPEDFAVYYCHQSSRLPHTFGQGTKVEIKR

SEQ ID NO: 175 - protein, 250 aa, Artificial Sequence
  Description of Artificial Sequence: Synthetic polypeptide
EVQLVQSGGGLVKPGGSLRLSCAASGFTFSSFAMHWVRQAPGKGLEWISVIDTRGATYYADSVKGRFTISRDNAKNSLYLQMNSLRAEDTAVYYCARLGNFYYGMDVWGQGTTVTVSSASTKGPSVFPLAPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 176 - protein, 228 aa, Artificial Sequence
  Description of Artificial Sequence: Synthetic polypeptide
EIVLTQSPGTLSVSPGERATLSCRASQSIGSSLHWYQQKPGQAPRLLIKYASQSLSGIPDRFSGSGSGTDFTLTISRLEPEDFAVYYCHQSSRLPHTFGQGTKVEIKRTVAAPSVFIFPPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 177 - protein, 250 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPEVQLVQSGGGLVKPGGSLRLSCAASGFTFSSFAMHWVRQAPGKGLEWISVIDTRGATYYADSVKGRFTISRDNAKNSLYLQMNSLRAEDTAVYYCARLGNFYYGMDVWGQGTTVTVSS

SEQ ID NO: 178 - protein, 228 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPEIVLTQSPGTLSVSPGERATLSCRASQSIGSSLHWYQQKPGQAPRLLIKYASQSLSGIPDRFSGSGSGTDFTLTISRLEPEDFAVYYCHQSSRLPHTFGQGTKVEIKR

SEQ ID NO: 179 - protein, 250 aa, Artificial Sequence; identical to SEQ ID NO: 175
  Description of Artificial Sequence: Synthetic polypeptide

SEQ ID NO: 180 - protein, 221 aa, Artificial Sequence; identical to SEQ ID NO: 172
  Description of Artificial Sequence: Synthetic polypeptide

SEQ ID NO: 181 - protein, 250 aa, Artificial Sequence; identical to SEQ ID NO: 177
  Description of Artificial Sequence: Synthetic polypeptide

SEQ ID NO: 182 - protein, 221 aa, Artificial Sequence; identical to SEQ ID NO: 174
  Description of Artificial Sequence: Synthetic polypeptide

SEQ ID NO: 183 - protein, 243 aa, Artificial Sequence; identical to SEQ ID NO: 171
  Description of Artificial Sequence: Synthetic polypeptide

SEQ ID NO: 184 - protein, 228 aa, Artificial Sequence; identical to SEQ ID NO: 176
  Description of Artificial Sequence: Synthetic polypeptide

SEQ ID NO: 185 - protein, 243 aa, Artificial Sequence; identical to SEQ ID NO: 173
  Description of Artificial Sequence: Synthetic polypeptide

SEQ ID NO: 186 - protein, 228 aa, Artificial Sequence; identical to SEQ ID NO: 178
  Description of Artificial Sequence: Synthetic polypeptide

SEQ ID NO: 187 - protein, 249 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPEVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSS

SEQ ID NO: 188 - protein, 227 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRR

SEQ ID NO: 189 - protein, 249 aa, Artificial Sequence
  Description of Artificial Sequence: Synthetic polypeptide
EVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 190 - protein, 227 aa, Artificial Sequence
  Description of Artificial Sequence: Synthetic polypeptide
DVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 191 - protein, 256 aa, Artificial Sequence
  Description of Artificial Sequence: Synthetic polypeptide
EVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSSASTKGPSVFPLAPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 192 - protein, 234 aa, Artificial Sequence
  Description of Artificial Sequence: Synthetic polypeptide
DVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRRTVAAPSVFIFPPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 193 - protein, 256 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPEVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSS

SEQ ID NO: 194 - protein, 234 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPDVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRR

SEQ ID NO: 195 - protein, 256 aa, Artificial Sequence; identical to SEQ ID NO: 191
  Description of Artificial Sequence: Synthetic polypeptide

SEQ ID NO: 196 - protein, 227 aa, Artificial Sequence; identical to SEQ ID NO: 190
  Description of Artificial Sequence: Synthetic polypeptide

SEQ ID NO: 197 - protein, 256 aa, Artificial Sequence; identical to SEQ ID NO: 193
  Description of Artificial Sequence: Synthetic polypeptide

SEQ ID NO: 198 - protein, 227 aa, Artificial Sequence; identical to SEQ ID NO: 188
  Description of Artificial Sequence: Synthetic polypeptide

SEQ ID NO: 199 - protein, 249 aa, Artificial Sequence; identical to SEQ ID NO: 189
  Description of Artificial Sequence: Synthetic polypeptide

SEQ ID NO: 200 - protein, 234 aa, Artificial Sequence; identical to SEQ ID NO: 192
  Description of Artificial Sequence: Synthetic polypeptide

SEQ ID NO: 201 - protein, 249 aa, Artificial Sequence; identical to SEQ ID NO: 187
  Description of Artificial Sequence: Synthetic polypeptide

SEQ ID NO: 202 - protein, 234 aa, Artificial Sequence; identical to SEQ ID NO: 194
  Description of Artificial Sequence: Synthetic polypeptide

SEQ ID NO: 203 - protein, 247 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 204 - protein, 221 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 205 - protein, 247 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 206 - protein, 221 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 207 - protein, 246 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPQVQLQQSGPELVRPGASVKWSCPASGYTFTSYWLHWVKKQRPGQGLEWIGMIDPSNSDTRFNPPNFKDKATLNVDRSSNTAYNLLSSLTSADSAVYYCATYGSYVSPLDYWGQGTSVYVSS

SEQ ID NO: 208 - protein, 227 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDIMMSQSPSSLTVSVGEKVTVSCKSSQSLLVTSSQKNYLAWYQQKPQQSPKLLIYWASTRESGVPDRFTGSGSGTDFTLTITSVKADDLAVYYCQQYYAYPWTFGDGTKLEIKR

SEQ ID NO: 209 - protein, 246 aa, Artificial Sequence
  Description of Artificial Sequence: Synthetic polypeptide
QVQLQQSGPELVRPGASVKWSCPASGYTFTSYWLHWVKKQRPGQGLEWIGMIDPSNSDTRFNPPNFKDKATLNVDRSSNTAYNLLSSLTSADSAVYYCATYGSYVSPLDYWGQGTSVYVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 210 - protein, 227 aa, Artificial Sequence
  Description of Artificial Sequence: Synthetic polypeptide
DIMMSQSPSSLTVSVGEKVTVSCKSSQSLLVTSSQKNYLAWYQQKPQQSPKLLIYWASTRESGVPDRFTGSGSGTDFTLTITSVKADDLAVYYCQQYYAYPWTFGDGTKLEIKRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 211 - protein, 246 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSS

SEQ ID NO: 212 - protein, 225 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPQSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLG

SEQ ID NO: 213 - protein, 246 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 214 - protein, 226 aa, Artificial Sequence
  Description of Artificial Sequence: Synthetic polypeptide
QSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLGQPKAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 215 - protein, 251 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPEVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSS

SEQ ID NO: 216 - protein, 221 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPDIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKR

SEQ ID NO: 217 - protein, 251 aa, Artificial Sequence
  Description of Artificial Sequence: Synthetic polypeptide
EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 218 - protein, 221 aa, Artificial Sequence
  Description of Artificial Sequence: Synthetic polypeptide
DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 219 - protein, 252 aa, Artificial Sequence
  Description of Artificial Sequence: Synthetic polypeptide
EVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSSASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 220 - protein, 227 aa, Artificial Sequence
  Description of Artificial Sequence: Synthetic polypeptide
DVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 221 - protein, 252 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPEVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSS

SEQ ID NO: 222 - protein, 227 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRR

SEQ ID NO: 223 - protein, 248 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 224 - protein, 221 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 225 - protein, 248 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 226 - protein, 221 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 227 - protein, 249 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 228 - protein, 221 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 229 - protein, 249 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 230 - protein, 221 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 231 - protein, 250 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSA

SEQ ID NO: 232 - protein, 220 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPQIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKR

SEQ ID NO: 233 - protein, 250 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 234 - protein, 220 aa, Artificial Sequence
  Description of Artificial Sequence: Synthetic polypeptide
QIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 235 - protein, 249 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSS

SEQ ID NO: 236 - protein, 225 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPQSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLG

SEQ ID NO: 237 - protein, 249 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 238 - protein, 226 aa, Artificial Sequence
  Description of Artificial Sequence: Synthetic polypeptide
QSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLGQPKAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 239 - protein, 247 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPEVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSS

SEQ ID NO: 240 - protein, 222 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKR

SEQ ID NO: 241 - protein, 247 aa, Artificial Sequence
  Description of Artificial Sequence: Synthetic polypeptide
EVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 242 - protein, 222 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 243 - protein, 251 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 244 - protein, 221 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 245 - protein, 251 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 246 - protein, 221 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 247 - protein, 258 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPSVFPLAPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 248 - protein, 228 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPSVFIFPPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 249 - protein, 258 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 250 - protein, 228 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 251 - protein, 258 aa, Artificial Sequence; identical to SEQ ID NO: 247
  Description of Artificial Sequence: Synthetic polypeptide

SEQ ID NO: 252 - protein, 221 aa, Artificial Sequence; identical to SEQ ID NO: 246
  Description of Artificial Sequence: Synthetic polypeptide

SEQ ID NO: 253 - protein, 258 aa, Artificial Sequence; identical to SEQ ID NO: 249
  Description of Artificial Sequence: Synthetic polypeptide

SEQ ID NO: 254 - protein, 221 aa, Artificial Sequence; identical to SEQ ID NO: 244
  Description of Artificial Sequence: Synthetic polypeptide

SEQ ID NO: 255 - protein, 251 aa, Artificial Sequence; identical to SEQ ID NO: 245
  Description of Artificial Sequence: Synthetic polypeptide

SEQ ID NO: 256 - protein, 228 aa, Artificial Sequence; identical to SEQ ID NO: 248
  Description of Artificial Sequence: Synthetic polypeptide

SEQ ID NO: 257 - protein, 251 aa, Artificial Sequence; identical to SEQ ID NO: 243
  Description of Artificial Sequence: Synthetic polypeptide

SEQ ID NO: 258 - protein, 228 aa, Artificial Sequence; identical to SEQ ID NO: 250
  Description of Artificial Sequence: Synthetic polypeptide

SEQ ID NO: 259 - protein, 253 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPEVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSS

SEQ ID NO: 260 - protein, 227 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRR

SEQ ID NO: 261 - protein, 253 aa, Artificial Sequence
  Description of Artificial Sequence: Synthetic polypeptide
EVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 262 - protein, 227 aa, Artificial Sequence
  Description of Artificial Sequence: Synthetic polypeptide
DVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 263 - protein, 248 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPEVQLVESGGGLVQPGGSLRLSCAASGFSFSSEPISWVRQAPGKGLEWVSSITGKNGYTYYADSVKGRFTISADTSKNTAYLQMNSLRAEDTAVYYCARWGKKVYGMDVWGQGTLVTVSS

SEQ ID NO: 264 - protein, 221 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDIQMTQSPSSLSASVGDRVTITCRASQSISSYLAWYQQKPGKAPKLLIYGASSRASGVPSRFSGSGSGTDFTLTISSLQPEDFATYYCQQYMSVPITFGQGTKVEIKR

SEQ ID NO: 265 - protein, 248 aa, Artificial Sequence
  Description of Artificial Sequence: Synthetic polypeptide
EVQLVESGGGLVQPGGSLRLSCAASGFSFSSEPISWVRQAPGKGLEWVSSITGKNGYTYYADSVKGRFTISADTSKNTAYLQMNSLRAEDTAVYYCARWGKKVYGMDVWGQGTLVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 266 - protein, 221 aa, Artificial Sequence
  Description of Artificial Sequence: Synthetic polypeptide
DIQMTQSPSSLSASVGDRVTITCRASQSISSYLAWYQQKPGKAPKLLIYGASSRASGVPSRFSGSGSGTDFTLTISSLQPEDFATYYCQQYMSVPITFGQGTKVEIKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 267 - protein, 255 aa, Artificial Sequence
  Description of Artificial Sequence: Synthetic polypeptide
QVQLQESGPGLVKPSEILSLTCTVSGGSISSHYWSWVRQPPGKGLEWIGYIYYSGSTNYNPSLKSRVTISVDTSKNQFSLNLSSVTAADTAVYYCARIPNYYDRSGYYPGYWYFDLWGRGTLVTVSSASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 268 - protein, 229 aa, Artificial Sequence
  Description of Artificial Sequence: Synthetic polypeptide
QAVLTQPSSLSAPPGASASLTCTLRSGFNVDSYRISWYQQKPGSPPQYLLRYKSDSDKQQGSGVPSRFSGSKDASANAGILLISGLQSEDEADYYCMIWHSSAWVFGGGTKLTVLRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 269 - protein, 255 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPQVQLQESGPGLVKPSEILSLTCTVSGGSISSHYWSWVRQPPGKGLEWIGYIYYSGSTNYNPSLKSRVTISVDTSKNQFSLNLSSVTAADTAVYYCARIPNYYDRSGYYPGYWYFDLWGRGTLVTVSS

SEQ ID NO: 270 - protein, 229 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPQAVLTQPSSLSAPPGASASLTCTLRSGFNVDSYRISWYQQKPGSPPQYLLRYKSDSDKQQGSGVPSRFSGSKDASANAGILLISGLQSEDEADYYCMIWHSSAWVFGGGTKLTVLR

SEQ ID NO: 271 - protein, 252 aa, Artificial Sequence
  Description of Artificial Sequence: Synthetic polypeptide
QVQLQESGPGLVKPSEILSLTCTVSGGSISSHYWSWVRQPPGKGLEWIGYIYYSGSTNYNPSLKSRVTISVDTSKNQFSLNLSSVTAADTAVYYCARIPNYYDRSGYYPGYWYFDLWGRGTLVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 272 - protein, 229 aa, Artificial Sequence
  Description of Artificial Sequence: Synthetic polypeptide
QAVLTQPSSLSAPPGASASLTCTLRSGFNVDSYRISWYQQKPGSPPQYLLRYKSDSDKQQGSGVPSRFSGSKDASANAGILLISGLQSEDEADYYCMIWHSSAWVFGGGTKLTVLRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 273 - protein, 252 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPQVQLQESGPGLVKPSEILSLTCTVSGGSISSHYWSWVRQPPGKGLEWIGYIYYSGSTNYNPSLKSRVTISVDTSKNQFSLNLSSVTAADTAVYYCARIPNYYDRSGYYPGYWYFDLWGRGTLVTVSS

SEQ ID NO: 274 - protein, 229 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPQAVLTQPSSLSAPPGASASLTCTLRSGFNVDSYRISWYQQKPGSPPQYLLRYKSDSDKQQGSGVPSRFSGSKDASANAGILLISGLQSEDEADYYCMIWHSSAWVFGGGTKLTVLR

SEQ ID NO: 275 - protein, 256 aa, Artificial Sequence
  Description of Artificial Sequence: Synthetic polypeptide
QVQLQESGPGLVKPSEILSLTCTVSGGSISSHYWSWVRQPPGKGLEWIGYIYYSGSTNYNPSLKSRVTISVDTSKNQFSLNLSSVTAADTAVYYCARIPNYYDRSGYYPGYWYFDLWGRGTLVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 276 - protein, 229 aa, Artificial Sequence
  Description of Artificial Sequence: Synthetic polypeptide
QAVLTQPSSLSAPPGASASLTCTLRSGFNVDSYRISWYQQKPGSPPQYLLRYKSDSDKQQGSGVPSRFSGSKDASANAGILLISGLQSEDEADYYCMIWHSSAWVFGGGTKLTVLRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 277 - protein, 256 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPQVQLQESGPGLVKPSEILSLTCTVSGGSISSHYWSWVRQPPGKGLEWIGYIYYSGSTNYNPSLKSRVTISVDTSKNQFSLNLSSVTAADTAVYYCARIPNYYDRSGYYPGYWYFDLWGRGTLVTVSS

SEQ ID NO: 278 - protein, 229 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPQAVLTQPSSLSAPPGASASLTCTLRSGFNVDSYRISWYQQKPGSPPQYLLRYKSDSDKQQGSGVPSRFSGSKDASANAGILLISGLQSEDEADYYCMIWHSSAWVFGGGTKLTVLR

SEQ ID NO: 279 - protein, 245 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 280 - protein, 221 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 281 - protein, 245 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS

SEQ ID NO: 282 - protein, 221 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 283 - protein, 244 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 284 - protein, 220 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPQIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINR

SEQ ID NO: 285 - protein, 244 aa, Artificial Sequence
  Description of Artificial Sequence: Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS

SEQ ID NO: 286 - protein, 220 aa, Artificial Sequence
  Description of Artificial Sequence: Synthetic polypeptide
QIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 287 - protein, 250 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPEVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSS

SEQ ID NO: 288 - protein, 221 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKR

SEQ ID NO: 289 - protein, 250 aa, Artificial Sequence
  Description of Artificial Sequence: Synthetic polypeptide
EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS

SEQ ID NO: 290 - protein, 221 aa, Artificial Sequence
  Description of Artificial Sequence: Synthetic polypeptide
DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 291 - protein, 249 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPEVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSS

SEQ ID NO: 292 - protein, 227 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRR

SEQ ID NO: 293 - protein, 249 aa, Artificial Sequence
  Description of Artificial Sequence: Synthetic polypeptide
EVQLVQSGGGLVKPGGSLRLSCAASGFTFSSYAMHWVRQAPGKGLEWVAVISYDGSNKYYADSVKGRFTISRDNSKNTLYLQMNSLRAEDTAVYYCARFSGWPNNYYYYGMDVWGQGTTVTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS

SEQ ID NO: 294 - protein, 227 aa, Artificial Sequence
  Description of Artificial Sequence: Synthetic polypeptide
DVVMTQSPLSLPVTPGEPASISCRSSQSLLHSNGFNYVDWYLQKPGQSPHLLIYFGSYRASGVPDRFSGSGSGTDFTLKISRVEAEDVGVYYCMQALQTPPWTFGQGTKVEIRRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 295 - protein, 252 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPQVQLQESGPGLVKPSEILSLTCTVSGGSISSHYWSWVRQPPGKGLEWIGYIYYSGSTNYNPSLKSRVTISVDTSKNQFSLNLSSVTAADTAVYYCARIPNYYDRSGYYPGYWYFDLWGRGTLVTVSS

SEQ ID NO: 296 - protein, 229 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPQAVLTQPSSLSAPPGASASLTCTLRSGFNVDSYRISWYQQKPGSPPQYLLRYKSDSDKQQGSGVPSRFSGSKDASANAGILLISGLQSEDEADYYCMIWHSSAWVFGGGTKLTVLR

SEQ ID NO: 297 - protein, 252 aa, Artificial Sequence
  Description of Artificial Sequence: Synthetic polypeptide
QVQLQESGPGLVKPSEILSLTCTVSGGSISSHYWSWVRQPPGKGLEWIGYIYYSGSTNYNPSLKSRVTISVDTSKNQFSLNLSSVTAADTAVYYCARIPNYYDRSGYYPGYWYFDLWGRGTLVTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS

SEQ ID NO: 298 - protein, 229 aa, Artificial Sequence
  Description of Artificial Sequence: Synthetic polypeptide
QAVLTQPSSLSAPPGASASLTCTLRSGFNVDSYRISWYQQKPGSPPQYLLRYKSDSDKQQGSGVPSRFSGSKDASANAGILLISGLQSEDEADYYCMIWHSSAWVFGGGTKLTVLRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 299 - protein, 247 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 300 - protein, 221 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 301 - protein, 247 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS

SEQ ID NO: 302 - protein, 221 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 303 - protein, 246 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPQVQLQQSGPELVRPGASVKWSCPASGYTFTSYWLHWVKKQRPGQGLEWIGMIDPSNSDTRFNPPNFKDKATLNVDRSSNTAYNLLSSLTSADSAVYYCATYGSYVSPLDYWGQGTSVYVSS

SEQ ID NO: 304 - protein, 227 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDIMMSQSPSSLTVSVGEKVTVSCKSSQSLLVTSSQKNYLAWYQQKPQQSPKLLIYWASTRESGVPDRFTGSGSGTDFTLTITSVKADDLAVYYCQQYYAYPWTFGDGTKLEIKR

SEQ ID NO: 305 - protein, 246 aa, Artificial Sequence
  Description of Artificial Sequence: Synthetic polypeptide
QVQLQQSGPELVRPGASVKWSCPASGYTFTSYWLHWVKKQRPGQGLEWIGMIDPSNSDTRFNPPNFKDKATLNVDRSSNTAYNLLSSLTSADSAVYYCATYGSYVSPLDYWGQGTSVYVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS

SEQ ID NO: 306 - protein, 227 aa, Artificial Sequence
  Description of Artificial Sequence: Synthetic polypeptide
DIMMSQSPSSLTVSVGEKVTVSCKSSQSLLVTSSQKNYLAWYQQKPQQSPKLLIYWASTRESGVPDRFTGSGSGTDFTLTITSVKADDLAVYYCQQYYAYPWTFGDGTKLEIKRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 307 - protein, 248 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 308 - protein, 221 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 309 - protein, 248 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS

SEQ ID NO: 310 - protein, 221 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 311 - protein, 251 aa, Artificial Sequence
  Description of Artificial Sequence: Synthetic polypeptide
EVQLVESGGGLVQPGGSLRLSCAASGFTFSSYAMSWVRQAPGKGLEWVSQISPAGGYTNYADSVKGRFTISADTSKNTAYLQMNSLRAEDTAVYYCARELPYYRMSKVMDVQGQGTLVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 312 - protein, 221 aa, Artificial Sequence
  Description of Artificial Sequence: Synthetic polypeptide
DIQMTQSPSSLSASVGDRVTITCRASQYFSSYLAWYQQKPGKAPKLLIYGASSRASGVPSRFSGSGSGTDFTLTISSLQPEDFATYYCQQYLGSPPTFGQGTKVEIKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 313 - protein, 251 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPEVQLVESGGGLVQPGGSLRLSCAASGFTFSSYAMSWVRQAPGKGLEWVSQISPAGGYTNYADSVKGRFTISADTSKNTAYLQMNSLRAEDTAVYYCARELPYYRMSKVMDVQGQGTLVTVSS

SEQ ID NO: 314 - protein, 221 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDIQMTQSPSSLSASVGDRVTITCRASQYFSSYLAWYQQKPGKAPKLLIYGASSRASGVPSRFSGSGSGTDFTLTISSLQPEDFATYYCQQYLGSPPTFGQGTKVEIKR

SEQ ID NO: 315 - protein, 246 aa, Artificial Sequence; identical to SEQ ID NO: 105
  Description of Artificial Sequence: Synthetic polypeptide

SEQ ID NO: 316 - protein, 219 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRTVAAPQIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKR

SEQ ID NO: 317 - protein, 246 aa, Artificial Sequence; identical to SEQ ID NO: 103
  Description of Artificial Sequence: Synthetic polypeptide

SEQ ID NO: 318 - protein, 219 aa, Artificial Sequence
  Description of Artificial Sequence: Synthetic polypeptide
QIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 319 - protein, 245 aa, Artificial Sequence; identical to SEQ ID NO: 119
  Description of Artificial Sequence: Synthetic polypeptide

SEQ ID NO: 320 - protein, 220 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 321 - protein, 245 aa, Artificial Sequence; identical to SEQ ID NO: 121
  Description of Artificial Sequence: Synthetic polypeptide

SEQ ID NO: 322 - protein, 220 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 323 - protein, 249 aa, Artificial Sequence; identical to SEQ ID NO: 123
  Description of Artificial Sequence: Synthetic polypeptide

SEQ ID NO: 324 - protein, 224 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRTVAAPDILLTQTPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKR

SEQ ID NO: 325 - protein, 249 aa, Artificial Sequence; identical to SEQ ID NO: 125
  Description of Artificial Sequence: Synthetic polypeptide

SEQ ID NO: 326 - protein, 224 aa, Artificial Sequence
  Description of Artificial Sequence: Synthetic polypeptide
DILLTQTPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKRTVAAPQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 327 - protein, 244 aa, Artificial Sequence; identical to SEQ ID NO: 133
  Description of Artificial Sequence: Synthetic polypeptide

SEQ ID NO: 328 - protein, 220 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 329 - protein, 244 aa, Artificial Sequence; identical to SEQ ID NO: 131
  Description of Artificial Sequence: Synthetic polypeptide

SEQ ID NO: 330 - protein, 220 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 331 - protein, 244 aa, Artificial Sequence; identical to SEQ ID NO: 285
  Description of Artificial Sequence: Synthetic polypeptide

SEQ ID NO: 332 - protein, 220 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 333 - protein, 244 aa, Artificial Sequence; identical to SEQ ID NO: 283
  Description of Artificial Sequence: Synthetic polypeptide

SEQ ID NO: 334 - protein, 220 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 335 - protein, 245 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSS

SEQ ID NO: 336 - protein, 225 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPQSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLG

SEQ ID NO: 337 - protein, 245 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS

SEQ ID NO: 338 - protein, 226 aa, Artificial Sequence
  Description of Artificial Sequence: Synthetic polypeptide
QSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLGQPKAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 339 - protein, 240 aa, Artificial Sequence
  Description of Artificial Sequence: Synthetic polypeptide
EVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSSASTKGPQVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSS

SEQ ID NO: 340 - protein, 227 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKRTVAAPDIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKR

SEQ ID NO: 341 - protein, 240 aa, Artificial Sequence
  Description of Artificial Sequence: Synthetic polypeptide
QVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSSASTKGPEVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSS

SEQ ID NO: 342 - protein, 227 aa, Artificial Sequence
  Description of Artificial Sequence: Synthetic polypeptide
DIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKRTVAAPDIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKR

SEQ ID NO: 343 - protein, 245 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPQVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSS

SEQ ID NO: 344 - protein, 226 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKR

SEQ ID NO: 345 - protein, 245 aa, Artificial Sequence
  Description of Artificial Sequence: Synthetic polypeptide
QVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 346 - protein, 226 aa, Artificial Sequence
  Description of Artificial Sequence: Synthetic polypeptide
DIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 347 - protein, 252 aa, Artificial Sequence
  Description of Artificial Sequence: Synthetic polypeptide
QVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSSASTKGPSVFPLAPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 348 - protein, 233 aa, Artificial Sequence
  Description of Artificial Sequence: Synthetic polypeptide
DIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKRTVAAPSVFIFPPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 349 - protein, 252 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPQVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSS

SEQ ID NO: 350 - protein, 233 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPDIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKR

SEQ ID NO: 351 - protein, 252 aa, Artificial Sequence; identical to SEQ ID NO: 347
  Description of Artificial Sequence: Synthetic polypeptide

SEQ ID NO: 352 - protein, 226 aa, Artificial Sequence; identical to SEQ ID NO: 346
  Description of Artificial Sequence: Synthetic polypeptide

SEQ ID NO: 353 - protein, 252 aa, Artificial Sequence; identical to SEQ ID NO: 349
  Description of Artificial Sequence: Synthetic polypeptide

SEQ ID NO: 354 - protein, 226 aa, Artificial Sequence; identical to SEQ ID NO: 344
  Description of Artificial Sequence: Synthetic polypeptide

SEQ ID NO: 355 - protein, 245 aa, Artificial Sequence; identical to SEQ ID NO: 345
  Description of Artificial Sequence: Synthetic polypeptide

SEQ ID NO: 356 - protein, 233 aa, Artificial Sequence; identical to SEQ ID NO: 348
  Description of Artificial Sequence: Synthetic polypeptide

SEQ ID NO: 357 - protein, 245 aa, Artificial Sequence; identical to SEQ ID NO: 343
  Description of Artificial Sequence: Synthetic polypeptide

SEQ ID NO: 358 - protein, 233 aa, Artificial Sequence; identical to SEQ ID NO: 350
  Description of Artificial Sequence: Synthetic polypeptide

SEQ ID NO: 359 - protein, 242 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 360 - protein, 227 aa, Artificial Sequence
  Description of Artificial Sequence: Synthetic polypeptide
DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 361 - protein, 242 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPQVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSS

SEQ ID NO: 362 - protein, 227 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKR

SEQ ID NO: 363 - protein, 249 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPSVFPLAPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 364 - protein, 234 aa, Artificial Sequence
  Description of Artificial Sequence: Synthetic polypeptide
DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPSVFIFPPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 365 - protein, 249 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPQVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSS

SEQ ID NO: 366 - protein, 234 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPDIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKR

SEQ ID NO: 367 - protein, 249 aa, Artificial Sequence; identical to SEQ ID NO: 363
  Description of Artificial Sequence: Synthetic polypeptide

SEQ ID NO: 368 - protein, 227 aa, Artificial Sequence; identical to SEQ ID NO: 360
  Description of Artificial Sequence: Synthetic polypeptide

SEQ ID NO: 369 - protein, 249 aa, Artificial Sequence; identical to SEQ ID NO: 365
  Description of Artificial Sequence: Synthetic polypeptide

SEQ ID NO: 370 - protein, 227 aa, Artificial Sequence; identical to SEQ ID NO: 362
  Description of Artificial Sequence: Synthetic polypeptide

SEQ ID NO: 371 - protein, 242 aa, Artificial Sequence; identical to SEQ ID NO: 359
  Description of Artificial Sequence: Synthetic polypeptide

SEQ ID NO: 372 - protein, 234 aa, Artificial Sequence; identical to SEQ ID NO: 364
  Description of Artificial Sequence: Synthetic polypeptide

SEQ ID NO: 373 - protein, 242 aa, Artificial Sequence; identical to SEQ ID NO: 361
  Description of Artificial Sequence: Synthetic polypeptide

SEQ ID NO: 374 - protein, 234 aa, Artificial Sequence; identical to SEQ ID NO: 366
  Description of Artificial Sequence: Synthetic polypeptide

SEQ ID NO: 375 - protein, 242 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS

SEQ ID NO: 376 - protein, 227 aa, Artificial Sequence
  Description of Artificial Sequence: Synthetic polypeptide
DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 377 - protein, 242 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPQVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSS

SEQ ID NO: 378 - protein, 227 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKR

SEQ ID NO: 379 - protein, 245 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 380 - protein, 227 aa, Artificial Sequence
  Description of Artificial Sequence: Synthetic polypeptide
DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 381 - protein, 245 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPQVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSS

SEQ ID NO: 382 - protein, 227 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKR

SEQ ID NO: 383 - protein, 244 aa, Artificial Sequence
  Description of Artificial Sequence: Synthetic polypeptide
EVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 384 - protein, 221 aa, Artificial Sequence
  Description of Artificial Sequence: Synthetic polypeptide
DIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKRTVAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 385 - protein, 244 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPEVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSS

SEQ ID NO: 386 - protein, 221 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPDIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKR

SEQ ID NO: 387 - protein, 251 aa, Artificial Sequence
  Description of Artificial Sequence: Synthetic polypeptide
EVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSSASTKGPSVFPLAPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 388 - protein, 228 aa, Artificial Sequence
  Description of Artificial Sequence: Synthetic polypeptide
DIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKRTVAAPSVFIFPPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 389 - protein, 251 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPEVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSS

SEQ ID NO: 390 - protein, 228 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPDIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKR

SEQ ID NO: 391 - protein, 251 aa, Artificial Sequence; identical to SEQ ID NO: 387
  Description of Artificial Sequence: Synthetic polypeptide

SEQ ID NO: 392 - protein, 221 aa, Artificial Sequence; identical to SEQ ID NO: 384
  Description of Artificial Sequence: Synthetic polypeptide

SEQ ID NO: 393 - protein, 251 aa, Artificial Sequence; identical to SEQ ID NO: 389
  Description of Artificial Sequence: Synthetic polypeptide

SEQ ID NO: 394 - protein, 221 aa, Artificial Sequence; identical to SEQ ID NO: 386
  Description of Artificial Sequence: Synthetic polypeptide

SEQ ID NO: 395 - protein, 244 aa, Artificial Sequence; identical to SEQ ID NO: 383
  Description of Artificial Sequence: Synthetic polypeptide

SEQ ID NO: 396 - protein, 228 aa, Artificial Sequence; identical to SEQ ID NO: 388
  Description of Artificial Sequence: Synthetic polypeptide

SEQ ID NO: 397 - protein, 244 aa, Artificial Sequence; identical to SEQ ID NO: 385
  Description of Artificial Sequence: Synthetic polypeptide

SEQ ID NO: 398 - protein, 228 aa, Artificial Sequence; identical to SEQ ID NO: 390
  Description of Artificial Sequence: Synthetic polypeptide

SEQ ID NO: 399 - protein, 244 aa, Artificial Sequence
  Description of Artificial Sequence: Synthetic polypeptide
EVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSSASTKGPQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS

SEQ ID NO: 400 - protein, 221 aa, Artificial Sequence
  Description of Artificial Sequence: Synthetic polypeptide
DIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKRTVAAPDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKR

SEQ ID NO: 401 - protein, 244 aa, Artificial Sequence
  Description of Artificial Sequence: Synthetic polypeptide
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPEVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSS

SEQ ID NO: 402 - protein, 221 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPDIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKR

SEQ ID NO: 403 - protein, 247 aa, Artificial Sequence
  Description of Artificial Sequence: Synthetic polypeptide
EVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSSASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 404 - protein, 221 aa, Artificial Sequence
  Description of Artificial Sequence: Synthetic polypeptide
DIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 405 - protein, 247 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPEVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSS

SEQ ID NO: 406 - protein, 221 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKR

SEQ ID NO: 407 - protein, 248 aa, Artificial Sequence
  Description of Artificial Sequence: Synthetic polypeptide
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 408 - protein, 225 aa, Artificial Sequence
  Description of Artificial Sequence: Synthetic polypeptide
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 409 - protein, 248 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPQVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSS

SEQ ID NO: 410 - protein, 225 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKR

SEQ ID NO: 411 - protein, 255 aa, Artificial Sequence
  Description of Artificial Sequence: Synthetic polypeptide
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSSASTKGPSVFPLAPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 412 - protein, 232 aa, Artificial Sequence
  Description of Artificial Sequence: Synthetic polypeptide
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKRTVAAPSVFIFPPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 413 - protein, 255 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPQVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSS

SEQ ID NO: 414 - protein, 232 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPDIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKR

SEQ ID NO: 415 - protein, 255 aa, Artificial Sequence; identical to SEQ ID NO: 411
  Description of Artificial Sequence: Synthetic polypeptide

SEQ ID NO: 416 - protein, 225 aa, Artificial Sequence; identical to SEQ ID NO: 408
  Description of Artificial Sequence: Synthetic polypeptide

SEQ ID NO: 417 - protein, 255 aa, Artificial Sequence; identical to SEQ ID NO: 413
  Description of Artificial Sequence: Synthetic polypeptide

SEQ ID NO: 418 - protein, 225 aa, Artificial Sequence; identical to SEQ ID NO: 410
  Description of Artificial Sequence: Synthetic polypeptide

SEQ ID NO: 419 - protein, 248 aa, Artificial Sequence; identical to SEQ ID NO: 407
  Description of Artificial Sequence: Synthetic polypeptide

SEQ ID NO: 420 - protein, 232 aa, Artificial Sequence; identical to SEQ ID NO: 412
  Description of Artificial Sequence: Synthetic polypeptide

SEQ ID NO: 421 - protein, 248 aa, Artificial Sequence; identical to SEQ ID NO: 409
  Description of Artificial Sequence: Synthetic polypeptide

SEQ ID NO: 422 - protein, 232 aa, Artificial Sequence; identical to SEQ ID NO: 414
  Description of Artificial Sequence: Synthetic polypeptide

SEQ ID NO: 423 - protein, 245 aa, Artificial Sequence
  Description of Artificial Sequence: Synthetic polypeptide
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSSASTKGPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 424 - protein, 225 aa, Artificial Sequence
  Description of Artificial Sequence: Synthetic polypeptide
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKRTVAAPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 425 - protein, 245 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPQVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSS

SEQ ID NO: 426 - protein, 225 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPDIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKR

SEQ ID NO: 427 - protein, 252 aa, Artificial Sequence
  Description of Artificial Sequence: Synthetic polypeptide
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSSASTKGPSVFPLAPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 428 - protein, 232 aa, Artificial Sequence
  Description of Artificial Sequence: Synthetic polypeptide
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 429 - protein, 252 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPSVFPLAPQVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSS

SEQ ID NO: 430 - protein, 232 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPDIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKR

SEQ ID NO: 431 - protein, 252 aa, Artificial Sequence; identical to SEQ ID NO: 427
  Description of Artificial Sequence: Synthetic polypeptide

SEQ ID NO: 432 - protein, 225 aa, Artificial Sequence; identical to SEQ ID NO: 424
  Description of Artificial Sequence: Synthetic polypeptide

SEQ ID NO: 433 - protein, 252 aa, Artificial Sequence; identical to SEQ ID NO: 429
  Description of Artificial Sequence: Synthetic polypeptide

SEQ ID NO: 434 - protein, 225 aa, Artificial Sequence; identical to SEQ ID NO: 426
  Description of Artificial Sequence: Synthetic polypeptide

SEQ ID NO: 435 - protein, 245 aa, Artificial Sequence; identical to SEQ ID NO: 423
  Description of Artificial Sequence: Synthetic polypeptide

SEQ ID NO: 436 - protein, 232 aa, Artificial Sequence; identical to SEQ ID NO: 428
  Description of Artificial Sequence: Synthetic polypeptide

SEQ ID NO: 437 - protein, 245 aa, Artificial Sequence; identical to SEQ ID NO: 425
  Description of Artificial Sequence: Synthetic polypeptide

SEQ ID NO: 438 - protein, 232 aa, Artificial Sequence; identical to SEQ ID NO: 430
  Description of Artificial Sequence: Synthetic polypeptide

SEQ ID NO: 439 - protein, 246 aa, Artificial Sequence
  Description of Artificial Sequence: Synthetic polypeptide
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSSASTKGPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 440 - protein, 225 aa, Artificial Sequence
  Description of Artificial Sequence: Synthetic polypeptide
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKRTVAAPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 441 - protein, 246 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPQVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSS

SEQ ID NO: 442 - protein, 225 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPDIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKR

SEQ ID NO: 443 - protein, 253 aa, Artificial Sequence
  Description of Artificial Sequence: Synthetic polypeptide
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSSASTKGPSVFPLAPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 444 - protein, 232 aa, Artificial Sequence
  Description of Artificial Sequence: Synthetic polypeptide
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKRTVAAPSVFIFPPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 445 - protein, 253 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPQVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSS

SEQ ID NO: 446 - protein, 232 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPDIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKR

SEQ ID NO: 447 - protein, 253 aa, Artificial Sequence; identical to SEQ ID NO: 443
  Description of Artificial Sequence: Synthetic polypeptide

SEQ ID NO: 448 - protein, 225 aa, Artificial Sequence; identical to SEQ ID NO: 440
  Description of Artificial Sequence: Synthetic polypeptide

SEQ ID NO: 449 - protein, 253 aa, Artificial Sequence; identical to SEQ ID NO: 445
  Description of Artificial Sequence: Synthetic polypeptide

SEQ ID NO: 450 - protein, 225 aa, Artificial Sequence; identical to SEQ ID NO: 442
  Description of Artificial Sequence: Synthetic polypeptide

SEQ ID NO: 451 - protein, 246 aa, Artificial Sequence; identical to SEQ ID NO: 439
  Description of Artificial Sequence: Synthetic polypeptide

SEQ ID NO: 452 - protein, 232 aa, Artificial Sequence; identical to SEQ ID NO: 444
  Description of Artificial Sequence: Synthetic polypeptide

SEQ ID NO: 453 - protein, 246 aa, Artificial Sequence; identical to SEQ ID NO: 441
  Description of Artificial Sequence: Synthetic polypeptide

SEQ ID NO: 454 - protein, 232 aa, Artificial Sequence; identical to SEQ ID NO: 446
  Description of Artificial Sequence: Synthetic polypeptide

SEQ ID NO: 455 - protein, 244 aa, Artificial Sequence
  Description of Artificial Sequence: Synthetic polypeptide
EVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSSASTKGPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 456 - protein, 222 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKRTVAAPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 457 - protein, 244 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPEVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSS

SEQ ID NO: 458 - protein, 222 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPDIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKR

SEQ ID NO: 459 - protein, 251 aa, Artificial Sequence
  Description of Artificial Sequence: Synthetic polypeptide
EVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSSASTKGPSVFPLAPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 460 - protein, 229 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 461 - protein, 251 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPSVFPLAPEVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSS

SEQ ID NO: 462 - protein, 229 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKR

SEQ ID NO: 463 - protein, 251 aa, Artificial Sequence; identical to SEQ ID NO: 459
  Description of Artificial Sequence: Synthetic polypeptide

SEQ ID NO: 464 - protein, 222 aa, Artificial Sequence; identical to SEQ ID NO: 456
  Description of Artificial Sequence: Synthetic polypeptide

SEQ ID NO: 465 - protein, 251 aa, Artificial Sequence; identical to SEQ ID NO: 461
  Description of Artificial Sequence: Synthetic polypeptide

SEQ ID NO: 466 - protein, 222 aa, Artificial Sequence; identical to SEQ ID NO: 458
  Description of Artificial Sequence: Synthetic polypeptide

SEQ ID NO: 467 - protein, 244 aa, Artificial Sequence; identical to SEQ ID NO: 455
  Description of Artificial Sequence: Synthetic polypeptide

SEQ ID NO: 468 - protein, 229 aa, Artificial Sequence; identical to SEQ ID NO: 460
  Description of Artificial Sequence: Synthetic polypeptide

SEQ ID NO: 469 - protein, 244 aa, Artificial Sequence; identical to SEQ ID NO: 457
  Description of Artificial Sequence: Synthetic polypeptide

SEQ ID NO: 470 - protein, 229 aa, Artificial Sequence; identical to SEQ ID NO: 462
  Description of Artificial Sequence: Synthetic polypeptide

SEQ ID NO: 471 - protein, 245 aa, Artificial Sequence
  Description of Artificial Sequence: Synthetic polypeptide
EVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSSASTKGPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 472 - protein, 222 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKRTVAAPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 473 - protein, 245 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPEVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSS

SEQ ID NO: 474 - protein, 222 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPDIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKR

SEQ ID NO: 475 - protein, 252 aa, Artificial Sequence
  Description of Artificial Sequence: Synthetic polypeptide
EVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSSASTKGPSVFPLAPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 476 - protein, 229 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKRTVAAPSVFIFPPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 477 - protein, 252 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPEVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSS

SEQ ID NO: 478 - protein, 229 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKR

SEQ ID NO: 479 - protein, 252 aa, Artificial Sequence; identical to SEQ ID NO: 475
  Description of Artificial Sequence: Synthetic polypeptide

SEQ ID NO: 480 - protein, 222 aa, Artificial Sequence; identical to SEQ ID NO: 472
  Description of Artificial Sequence: Synthetic polypeptide

SEQ ID NO: 481 - protein, 252 aa, Artificial Sequence; identical to SEQ ID NO: 477
  Description of Artificial Sequence: Synthetic polypeptide

SEQ ID NO: 482 - protein, 222 aa, Artificial Sequence; identical to SEQ ID NO: 474
  Description of Artificial Sequence: Synthetic polypeptide

SEQ ID NO: 483 - protein, 245 aa, Artificial Sequence; identical to SEQ ID NO: 471
  Description of Artificial Sequence: Synthetic polypeptide

SEQ ID NO: 484 - protein, 229 aa, Artificial Sequence; identical to SEQ ID NO: 476
  Description of Artificial Sequence: Synthetic polypeptide

SEQ ID NO: 485 - protein, 245 aa, Artificial Sequence; identical to SEQ ID NO: 473
  Description of Artificial Sequence: Synthetic polypeptide

SEQ ID NO: 486 - protein, 229 aa, Artificial Sequence; identical to SEQ ID NO: 478
  Description of Artificial Sequence: Synthetic polypeptide

SEQ ID NO: 487 - protein, 254 aa, Artificial Sequence
  Description of Artificial Sequence: Synthetic polypeptide
EVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSSASTKGPSVFPLAPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 488 - protein, 229 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKRTVAAPSVFIFPPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 489 - protein, 254 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPEVQLVESGGGLVQPGGSLRLSCAASGFTFTDNWISWVRQAPGKGLEWVGYISPNSGFTYYADSVKGRFTISADTSKNTAYLQMNSLRAEDTAVYYCARDNFGGYFDYWGQGTLVTVSS

SEQ ID NO: 490 - protein, 229 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATTYYCQQSYTGTVTFGQGTKVEIKR

SEQ ID NO: 491 - protein, 254 aa, Artificial Sequence; identical to SEQ ID NO: 487
  Description of Artificial Sequence: Synthetic polypeptide

SEQ ID NO: 492 - protein, 222 aa, Artificial Sequence; identical to SEQ ID NO: 242
  Description of Artificial Sequence: Synthetic polypeptide

SEQ ID NO: 493 - protein, 254 aa, Artificial Sequence; identical to SEQ ID NO: 489
  Description of Artificial Sequence: Synthetic polypeptide

SEQ ID NO: 494 - protein, 222 aa, Artificial Sequence; identical to SEQ ID NO: 240
  Description of Artificial Sequence: Synthetic polypeptide

SEQ ID NO: 495 - protein, 247 aa, Artificial Sequence; identical to SEQ ID NO: 241
  Description of Artificial Sequence: Synthetic polypeptide

SEQ ID NO: 496 - protein, 229 aa, Artificial Sequence; identical to SEQ ID NO: 488
  Description of Artificial Sequence: Synthetic polypeptide

SEQ ID NO: 497 - protein, 247 aa, Artificial Sequence; identical to SEQ ID NO: 239
  Description of Artificial Sequence: Synthetic polypeptide

SEQ ID NO: 498 - protein, 229 aa, Artificial Sequence; identical to SEQ ID NO: 490
  Description of Artificial Sequence: Synthetic polypeptide

SEQ ID NO: 499 - protein, 249 aa, Artificial Sequence
  Description of Artificial Sequence: Synthetic polypeptide
EVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 500 - protein, 221 aa, Artificial Sequence
  Description of Artificial Sequence: Synthetic polypeptide
DIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 501 - protein, 249 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPEVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSS

SEQ ID NO: 502 - protein, 221 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKR

SEQ ID NO: 503 - protein, 256 aa, Artificial Sequence
  Description of Artificial Sequence: Synthetic polypeptide
EVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSSASTKGPSVFPLAPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 504 - protein, 228 aa, Artificial Sequence
  Description of Artificial Sequence: Synthetic polypeptide
DIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKRTVAAPSVFIFPPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 505 - protein, 256 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPEVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSS

SEQ ID NO: 506 - protein, 228 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPDIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKR

SEQ ID NO: 507 - protein, 256 aa, Artificial Sequence; identical to SEQ ID NO: 503
  Description of Artificial Sequence: Synthetic polypeptide

SEQ ID NO: 508 - protein, 221 aa, Artificial Sequence; identical to SEQ ID NO: 500
  Description of Artificial Sequence: Synthetic polypeptide

SEQ ID NO: 509 - protein, 256 aa, Artificial Sequence; identical to SEQ ID NO: 505
  Description of Artificial Sequence: Synthetic polypeptide

SEQ ID NO: 510 - protein, 221 aa, Artificial Sequence; identical to SEQ ID NO: 502
  Description of Artificial Sequence: Synthetic polypeptide

SEQ ID NO: 511 - protein, 249 aa, Artificial Sequence; identical to SEQ ID NO: 499
  Description of Artificial Sequence: Synthetic polypeptide

SEQ ID NO: 512 - protein, 228 aa, Artificial Sequence; identical to SEQ ID NO: 504
  Description of Artificial Sequence: Synthetic polypeptide

SEQ ID NO: 513 - protein, 249 aa, Artificial Sequence; identical to SEQ ID NO: 501
  Description of Artificial Sequence: Synthetic polypeptide

SEQ ID NO: 514 - protein, 228 aa, Artificial Sequence; identical to SEQ ID NO: 506
  Description of Artificial Sequence: Synthetic polypeptide

SEQ ID NO: 515 - protein, 246 aa, Artificial Sequence
  Description of Artificial Sequence: Synthetic polypeptide
EVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSSASTKGPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 516 - protein, 221 aa, Artificial Sequence
  Description of Artificial Sequence: Synthetic polypeptide
DIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKRTVAAPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 517 - protein, 246 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPEVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSS

SEQ ID NO: 518 - protein, 221 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPDIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKR

SEQ ID NO: 519 - protein, 253 aa, Artificial Sequence
  Description of Artificial Sequence: Synthetic polypeptide
EVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSSASTKGPSVFPLAPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 520 - protein, 228 aa, Artificial Sequence
  Description of Artificial Sequence: Synthetic polypeptide
DIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 521 - protein, 253 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPSVFPLAPEVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSS

SEQ ID NO: 522 - protein, 228 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPDIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKR

SEQ ID NO: 523 - protein, 253 aa, Artificial Sequence; identical to SEQ ID NO: 519
  Description of Artificial Sequence: Synthetic polypeptide

SEQ ID NO: 524 - protein, 221 aa, Artificial Sequence; identical to SEQ ID NO: 516
  Description of Artificial Sequence: Synthetic polypeptide

SEQ ID NO: 525 - protein, 253 aa, Artificial Sequence; identical to SEQ ID NO: 521
  Description of Artificial Sequence: Synthetic polypeptide

SEQ ID NO: 526 - protein, 221 aa, Artificial Sequence; identical to SEQ ID NO: 518
  Description of Artificial Sequence: Synthetic polypeptide

SEQ ID NO: 527 - protein, 246 aa, Artificial Sequence; identical to SEQ ID NO: 515
  Description of Artificial Sequence: Synthetic polypeptide

SEQ ID NO: 528 - protein, 228 aa, Artificial Sequence; identical to SEQ ID NO: 520
  Description of Artificial Sequence: Synthetic polypeptide

SEQ ID NO: 529 - protein, 246 aa, Artificial Sequence; identical to SEQ ID NO: 517
  Description of Artificial Sequence: Synthetic polypeptide

SEQ ID NO: 530 - protein, 228 aa, Artificial Sequence; identical to SEQ ID NO: 522
  Description of Artificial Sequence: Synthetic polypeptide

SEQ ID NO: 531 - protein, 247 aa, Artificial Sequence
  Description of Artificial Sequence: Synthetic polypeptide
EVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSSASTKGPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 532 - protein, 221 aa, Artificial Sequence
  Description of Artificial Sequence: Synthetic polypeptide
DIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKRTVAAPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 533 - protein, 247 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPEVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSS

SEQ ID NO: 534 - protein, 221 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPDIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKR

SEQ ID NO: 535 - protein, 254 aa, Artificial Sequence
  Description of Artificial Sequence: Synthetic polypeptide
EVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSSASTKGPSVFPLAPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 536 - protein, 228 aa, Artificial Sequence
  Description of Artificial Sequence: Synthetic polypeptide
DIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKRTVAAPSVFIFPPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 537 - protein, 254 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPEVQLQQSGPELVKPGASVKMSCKASGYTFTSYVINWVKQKPGQGLEWIGLINPYNDGTKYNEKFKVKATLTSDKSSSTAYMELSSLTSEDSAVYYCASYYYGSRYYFDYWGQGTTLTVSS

SEQ ID NO: 538 - protein, 228 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPDIQMTQSSSYLSVSLGGRVTITCKASDHINNWLAWYQQKPGNAPRLLISGATSLETGVPSRFSGSGSGKDYTLSITSLQTEDVATYYCQQYWSIPLTFGAGTKLELKR

SEQ ID NO: 539 - protein, 254 aa, Artificial Sequence; identical to SEQ ID NO: 535
  Description of Artificial Sequence: Synthetic polypeptide

SEQ ID NO: 540 - protein, 221 aa, Artificial Sequence; identical to SEQ ID NO: 532
  Description of Artificial Sequence: Synthetic polypeptide

SEQ ID NO: 541 - protein, 254 aa, Artificial Sequence; identical to SEQ ID NO: 537
  Description of Artificial Sequence: Synthetic polypeptide

SEQ ID NO: 542 - protein, 221 aa, Artificial Sequence; identical to SEQ ID NO: 534
  Description of Artificial Sequence: Synthetic polypeptide

SEQ ID NO: 543 - protein, 247 aa, Artificial Sequence; identical to SEQ ID NO: 531
  Description of Artificial Sequence: Synthetic polypeptide

SEQ ID NO: 544 - protein, 228 aa, Artificial Sequence; identical to SEQ ID NO: 536
  Description of Artificial Sequence: Synthetic polypeptide

SEQ ID NO: 545 - protein, 247 aa, Artificial Sequence; identical to SEQ ID NO: 533
  Description of Artificial Sequence: Synthetic polypeptide

SEQ ID NO: 546 - protein, 228 aa, Artificial Sequence; identical to SEQ ID NO: 538
  Description of Artificial Sequence: Synthetic polypeptide

SEQ ID NO: 547 - protein, 249 aa, Artificial Sequence
  Description of Artificial Sequence: Synthetic polypeptide
EVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 548 - protein, 224 aa, Artificial Sequence
  Description of Artificial Sequence: Synthetic polypeptide
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGQPKAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 549 - protein, 249 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPEVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSS

SEQ ID NO: 550 - protein, 223 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPQAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 551 - protein, 256 aa, Artificial Sequence
  Description of Artificial Sequence: Synthetic polypeptide
EVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSSASTKGPSVFPLAPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 552 - protein, 231 aa, Artificial Sequence
  Description of Artificial Sequence: Synthetic polypeptide
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGQPKAAPSVTLFPPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 553 - protein, 256 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPEVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSS

SEQ ID NO: 554 - protein, 230 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPQAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 555 - protein, 256 aa, Artificial Sequence; identical to SEQ ID NO: 551
  Description of Artificial Sequence: Synthetic polypeptide

SEQ ID NO: 556 - protein, 224 aa, Artificial Sequence; identical to SEQ ID NO: 548
  Description of Artificial Sequence: Synthetic polypeptide

SEQ ID NO: 557 - protein, 256 aa, Artificial Sequence; identical to SEQ ID NO: 553
  Description of Artificial Sequence: Synthetic polypeptide

SEQ ID NO: 558 - protein, 223 aa, Artificial Sequence; identical to SEQ ID NO: 550
  Description of Artificial Sequence: Synthetic polypeptide

SEQ ID NO: 559 - protein, 249 aa, Artificial Sequence; identical to SEQ ID NO: 547
  Description of Artificial Sequence: Synthetic polypeptide

SEQ ID NO: 560 - protein, 231 aa, Artificial Sequence; identical to SEQ ID NO: 552
  Description of Artificial Sequence: Synthetic polypeptide

SEQ ID NO: 561 - protein, 249 aa, Artificial Sequence; identical to SEQ ID NO: 549
  Description of Artificial Sequence: Synthetic polypeptide

SEQ ID NO: 562 - protein, 230 aa, Artificial Sequence; identical to SEQ ID NO: 554
  Description of Artificial Sequence: Synthetic polypeptide

SEQ ID NO: 563 - protein, 246 aa, Artificial Sequence
  Description of Artificial Sequence: Synthetic polypeptide
EVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSSASTKGPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 564 - protein, 224 aa, Artificial Sequence
  Description of Artificial Sequence: Synthetic polypeptide
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGQPKAAPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 565 - protein, 246 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPEVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSS

SEQ ID NO: 566 - protein, 223 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPQAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 567 - protein, 253 aa, Artificial Sequence
  Description of Artificial Sequence: Synthetic polypeptide
EVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSSASTKGPSVFPLAPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 568 - protein, 231 aa, Artificial Sequence
  Description of Artificial Sequence: Synthetic polypeptide
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGQPKAAPSVTLFPPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 569 - protein, 253 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPSVFPLAPEVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSS

SEQ ID NO: 570 - protein, 230 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPQAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 571 - protein, 253 aa, Artificial Sequence; identical to SEQ ID NO: 567
  Description of Artificial Sequence: Synthetic polypeptide

SEQ ID NO: 572 - protein, 224 aa, Artificial Sequence; identical to SEQ ID NO: 564
  Description of Artificial Sequence: Synthetic polypeptide

SEQ ID NO: 573 - protein, 253 aa, Artificial Sequence; identical to SEQ ID NO: 569
  Description of Artificial Sequence: Synthetic polypeptide

SEQ ID NO: 574 - protein, 223 aa, Artificial Sequence; identical to SEQ ID NO: 566
  Description of Artificial Sequence: Synthetic polypeptide

SEQ ID NO: 575 - protein, 246 aa, Artificial Sequence; identical to SEQ ID NO: 563
  Description of Artificial Sequence: Synthetic polypeptide

SEQ ID NO: 576 - protein, 231 aa, Artificial Sequence; identical to SEQ ID NO: 568
  Description of Artificial Sequence: Synthetic polypeptide

SEQ ID NO: 577 - protein, 246 aa, Artificial Sequence; identical to SEQ ID NO: 565
  Description of Artificial Sequence: Synthetic polypeptide

SEQ ID NO: 578 - protein, 230 aa, Artificial Sequence; identical to SEQ ID NO: 570
  Description of Artificial Sequence: Synthetic polypeptide

SEQ ID NO: 579 - protein, 247 aa, Artificial Sequence
  Description of Artificial Sequence: Synthetic polypeptide
EVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSSASTKGPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 580 - protein, 224 aa, Artificial Sequence
  Description of Artificial Sequence: Synthetic polypeptide
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGQPKAAPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 581 - protein, 247 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPEVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSS

SEQ ID NO: 582 - protein, 223 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPQAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 583 - protein, 254 aa, Artificial Sequence
  Description of Artificial Sequence: Synthetic polypeptide
EVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSSASTKGPSVFPLAPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 584 - protein, 231 aa, Artificial Sequence
  Description of Artificial Sequence: Synthetic polypeptide
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGQPKAAPSVTLFPPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 585 - protein, 254 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPEVQLQQSGPELEKPGASVKISCKASGYSFTGYNMNWVKQSNGKSLEWIGNIDPYFGGTNYNQKFKGKATLTVDKSSSTAYMQLKSLTSEDSAVYYCARNYDYDGGCFDYWGQGTTLTVSS

SEQ ID NO: 586 - protein, 230 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPQAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 587 - protein, 254 aa, Artificial Sequence; identical to SEQ ID NO: 583
  Description of Artificial Sequence: Synthetic polypeptide

SEQ ID NO: 588 - protein, 224 aa, Artificial Sequence; identical to SEQ ID NO: 580
  Description of Artificial Sequence: Synthetic polypeptide

SEQ ID NO: 589 - protein, 254 aa, Artificial Sequence; identical to SEQ ID NO: 585
  Description of Artificial Sequence: Synthetic polypeptide

SEQ ID NO: 590 - protein, 223 aa, Artificial Sequence; identical to SEQ ID NO: 582
  Description of Artificial Sequence: Synthetic polypeptide

SEQ ID NO: 591 - protein, 247 aa, Artificial Sequence; identical to SEQ ID NO: 579
  Description of Artificial Sequence: Synthetic polypeptide

SEQ ID NO: 592 - protein, 231 aa, Artificial Sequence; identical to SEQ ID NO: 584
  Description of Artificial Sequence: Synthetic polypeptide

SEQ ID NO: 593 - protein, 247 aa, Artificial Sequence; identical to SEQ ID NO: 581
  Description of Artificial Sequence: Synthetic polypeptide

SEQ ID NO: 594 - protein, 230 aa, Artificial Sequence; identical to SEQ ID NO: 586
  Description of Artificial Sequence: Synthetic polypeptide

SEQ ID NO: 595 - protein, 250 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPSVFPLAPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 596 - protein, 234 aa, Artificial Sequence
  Description of Artificial Sequence: Synthetic polypeptide
DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPSVFIFPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 597 - protein, 250 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPQVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSS

SEQ ID NO: 598 - protein, 234 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPDIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKR

SEQ ID NO: 599 - protein, 250 aa, Artificial Sequence; identical to SEQ ID NO: 595
  Description of Artificial Sequence: Synthetic polypeptide

SEQ ID NO: 600 - protein, 227 aa, Artificial Sequence
  Description of Artificial Sequence: Synthetic polypeptide
DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 601 - protein, 250 aa, Artificial Sequence; identical to SEQ ID NO: 597
  Description of Artificial Sequence: Synthetic polypeptide

SEQ ID NO: 602 - protein, 227 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPDIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKR

SEQ ID NO: 603 - protein, 243 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 604 - protein, 234 aa, Artificial Sequence; identical to SEQ ID NO: 596
  Description of Artificial Sequence: Synthetic polypeptide

SEQ ID NO: 605 - protein, 243 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPQVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSS

SEQ ID NO: 606 - protein, 234 aa, Artificial Sequence; identical to SEQ ID NO: 598
  Description of Artificial Sequence: Synthetic polypeptide

SEQ ID NO: 607 - protein, 243 aa, Artificial Sequence; identical to SEQ ID NO: 603
  Description of Artificial Sequence: Synthetic polypeptide

SEQ ID NO: 608 - protein, 227 aa, Artificial Sequence; identical to SEQ ID NO: 600
  Description of Artificial Sequence: Synthetic polypeptide

SEQ ID NO: 609 - protein, 243 aa, Artificial Sequence; identical to SEQ ID NO: 605
  Description of Artificial Sequence: Synthetic polypeptide

SEQ ID NO: 610 - protein, 227 aa, Artificial Sequence; identical to SEQ ID NO: 602
  Description of Artificial Sequence: Synthetic polypeptide

SEQ ID NO: 611 - protein, 252 aa, Artificial Sequence
  Description of Artificial Sequence: Synthetic polypeptide
EVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSSASTKGPSVFPLAPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 612 - protein, 228 aa, Artificial Sequence
  Description of Artificial Sequence: Synthetic polypeptide
DIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKRTVAAPSVFIFPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 613 - protein, 252 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPEVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSS

SEQ ID NO: 614 - protein, 228 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPDIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKR

SEQ ID NO: 615 - protein, 252 aa, Artificial Sequence; identical to SEQ ID NO: 611
  Description of Artificial Sequence: Synthetic polypeptide

SEQ ID NO: 616 - protein, 221 aa, Artificial Sequence
  Description of Artificial Sequence: Synthetic polypeptide
DIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 617 - protein, 252 aa, Artificial Sequence; identical to SEQ ID NO: 613
  Description of Artificial Sequence: Synthetic polypeptide

SEQ ID NO: 618 - protein, 221 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPDIQMTQSPSSLSASVGDRVTITCQASQDITNYLNWYQQKPGKAPKLLIYDASNLETGVPSRFSGSGSGTDFTFTISSLQPEDIATYNCQQCENFPITFGQGTRLEIKR

SEQ ID NO: 619 - protein, 245 aa, Artificial Sequence
  Description of Artificial Sequence: Synthetic polypeptide
EVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 620 - protein, 228 aa, Artificial Sequence; identical to SEQ ID NO: 612
  Description of Artificial Sequence: Synthetic polypeptide

SEQ ID NO: 621 - protein, 245 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPEVQLVESGGGLVQPGGSLRLSCAASGFTFSIYSMNWVRQAPGKGLEWVSYISSSSSTIYYADSVKGRFTISRDNAKNSLYLQMNSLRDEDTAVYYCARDRGDFDAFDIWGQGTMVTVSS

SEQ ID NO: 622 - protein, 228 aa, Artificial Sequence; identical to SEQ ID NO: 614
  Description of Artificial Sequence: Synthetic polypeptide

SEQ ID NO: 623 - protein, 245 aa, Artificial Sequence; identical to SEQ ID NO: 619
  Description of Artificial Sequence: Synthetic polypeptide

SEQ ID NO: 624 - protein, 221 aa, Artificial Sequence; identical to SEQ ID NO: 616
  Description of Artificial Sequence: Synthetic polypeptide

SEQ ID NO: 625 - protein, 245 aa, Artificial Sequence; identical to SEQ ID NO: 621
  Description of Artificial Sequence: Synthetic polypeptide

SEQ ID NO: 626 - protein, 221 aa, Artificial Sequence; identical to SEQ ID NO: 618
  Description of Artificial Sequence: Synthetic polypeptide

SEQ ID NO: 627 - protein, 244 aa, Artificial Sequence
  Description of Artificial Sequence: Synthetic polypeptide
EVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSSASTKGPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 628 - protein, 226 aa, Artificial Sequence
  Description of Artificial Sequence: Synthetic polypeptide
QSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLGQPKAAPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 629 - protein, 244 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPEVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSS

SEQ ID NO: 630 - protein, 225 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPQSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLG

SEQ ID NO: 631 - protein, 251 aa, Artificial Sequence
  Description of Artificial Sequence: Synthetic polypeptide
EVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSSASTKGPSVFPLAPQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 632 - protein, 233 aa, Artificial Sequence
  Description of Artificial Sequence: Synthetic polypeptide
QSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLGQPKAAPSVTLFPPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 633 - protein, 251 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPEVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSS

SEQ ID NO: 634 - protein, 232 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPQSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLG

SEQ ID NO: 635 - protein, 251 aa, Artificial Sequence; identical to SEQ ID NO: 631
  Description of Artificial Sequence: Synthetic polypeptide

SEQ ID NO: 636 - protein, 226 aa, Artificial Sequence; identical to SEQ ID NO: 628
  Description of Artificial Sequence: Synthetic polypeptide

SEQ ID NO: 637 - protein, 251 aa, Artificial Sequence; identical to SEQ ID NO: 633
  Description of Artificial Sequence: Synthetic polypeptide

SEQ ID NO: 638 - protein, 225 aa, Artificial Sequence; identical to SEQ ID NO: 630
  Description of Artificial Sequence: Synthetic polypeptide

SEQ ID NO: 639 - protein, 244 aa, Artificial Sequence; identical to SEQ ID NO: 627
  Description of Artificial Sequence: Synthetic polypeptide

SEQ ID NO: 640 - protein, 233 aa, Artificial Sequence; identical to SEQ ID NO: 632
  Description of Artificial Sequence: Synthetic polypeptide

SEQ ID NO: 641 - protein, 244 aa, Artificial Sequence; identical to SEQ ID NO: 629
  Description of Artificial Sequence: Synthetic polypeptide

SEQ ID NO: 642 - protein, 232 aa, Artificial Sequence; identical to SEQ ID NO: 634
  Description of Artificial Sequence: Synthetic polypeptide

SEQ ID NO: 643 - protein, 245 aa, Artificial Sequence
  Description of Artificial Sequence: Synthetic polypeptide
EVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 644 - protein, 226 aa, Artificial Sequence
  Description of Artificial Sequence: Synthetic polypeptide
QSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLGQPKAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 645 - protein, 245 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPEVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSS

SEQ ID NO: 646 - protein, 225 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPQSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLG

SEQ ID NO: 647 - protein, 252 aa, Artificial Sequence
  Description of Artificial Sequence: Synthetic polypeptide
EVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSSASTKGPSVFPLAPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 648 - protein, 233 aa, Artificial Sequence
  Description of Artificial Sequence: Synthetic polypeptide
QSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLGQPKAAPSVTLFPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 649 - protein, 252 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPEVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSS

SEQ ID NO: 650 - protein, 232 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPQSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLG

SEQ ID NO: 651 - protein, 252 aa, Artificial Sequence; identical to SEQ ID NO: 647
  Description of Artificial Sequence: Synthetic polypeptide

SEQ ID NO: 652 - protein, 226 aa, Artificial Sequence; identical to SEQ ID NO: 644
  Description of Artificial Sequence: Synthetic polypeptide

SEQ ID NO: 653 - protein, 252 aa, Artificial Sequence; identical to SEQ ID NO: 649
  Description of Artificial Sequence: Synthetic polypeptide

SEQ ID NO: 654 - protein, 225 aa, Artificial Sequence; identical to SEQ ID NO: 646
  Description of Artificial Sequence: Synthetic polypeptide

SEQ ID NO: 655 - protein, 245 aa, Artificial Sequence; identical to SEQ ID NO: 643
  Description of Artificial Sequence: Synthetic polypeptide

SEQ ID NO: 656 - protein, 233 aa, Artificial Sequence; identical to SEQ ID NO: 648
  Description of Artificial Sequence: Synthetic polypeptide

SEQ ID NO: 657 - protein, 245 aa, Artificial Sequence; identical to SEQ ID NO: 645
  Description of Artificial Sequence: Synthetic polypeptide

SEQ ID NO: 658 - protein, 232 aa, Artificial Sequence; identical to SEQ ID NO: 650
  Description of Artificial Sequence: Synthetic polypeptide

SEQ ID NO: 659 - protein, 245 aa, Artificial Sequence
  Description of Artificial Sequence: Synthetic polypeptide
QVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 660 - protein, 221 aa, Artificial Sequence
  Description of Artificial Sequence: Synthetic polypeptide
AIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 661 - protein, 245 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPQVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSS

SEQ ID NO: 662 - protein, 221 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPAIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKR

SEQ ID NO: 663 - protein, 252 aa, Artificial Sequence
  Description of Artificial Sequence: Synthetic polypeptide
QVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSSASTKGPSVFPLAPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 664 - protein, 228 aa, Artificial Sequence
  Description of Artificial Sequence: Synthetic polypeptide
AIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKRTVAAPSVFIFPPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 665 - protein, 252 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPQVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSS

SEQ ID NO: 666 - protein, 228 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPAIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKR

SEQ ID NO: 667 - protein, 252 aa, Artificial Sequence; identical to SEQ ID NO: 663
  Description of Artificial Sequence: Synthetic polypeptide

SEQ ID NO: 668 - protein, 221 aa, Artificial Sequence; identical to SEQ ID NO: 660
  Description of Artificial Sequence: Synthetic polypeptide

SEQ ID NO: 669 - protein, 252 aa, Artificial Sequence; identical to SEQ ID NO: 665
  Description of Artificial Sequence: Synthetic polypeptide

SEQ ID NO: 670 - protein, 221 aa, Artificial Sequence; identical to SEQ ID NO: 662
  Description of Artificial Sequence: Synthetic polypeptide

SEQ ID NO: 671 - protein, 245 aa, Artificial Sequence; identical to SEQ ID NO: 659
  Description of Artificial Sequence: Synthetic polypeptide

SEQ ID NO: 672 - protein, 228 aa, Artificial Sequence; identical to SEQ ID NO: 664
  Description of Artificial Sequence: Synthetic polypeptide

SEQ ID NO: 673 - protein, 245 aa, Artificial Sequence; identical to SEQ ID NO: 661
  Description of Artificial Sequence: Synthetic polypeptide

SEQ ID NO: 674 - protein, 228 aa, Artificial Sequence; identical to SEQ ID NO: 666
  Description of Artificial Sequence: Synthetic polypeptide

SEQ ID NO: 675 - protein, 242 aa, Artificial Sequence
  Description of Artificial Sequence: Synthetic polypeptide
QVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSSASTKGPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 676 - protein, 221 aa, Artificial Sequence
  Description of Artificial Sequence: Synthetic polypeptide
AIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKRTVAAPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 677 - protein, 242 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPQVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSS

SEQ ID NO: 678 - protein, 221 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPAIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKR

SEQ ID NO: 679 - protein, 249 aa, Artificial Sequence
  Description of Artificial Sequence: Synthetic polypeptide
QVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSSASTKGPSVFPLAPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 680 - protein, 228 aa, Artificial Sequence
  Description of Artificial Sequence: Synthetic polypeptide
AIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 681 - protein, 249 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPSVFPLAPQVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSS

SEQ ID NO: 682 - protein, 228 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPAIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKR

SEQ ID NO: 683 - protein, 249 aa, Artificial Sequence; identical to SEQ ID NO: 679
  Description of Artificial Sequence: Synthetic polypeptide

SEQ ID NO: 684 - protein, 221 aa, Artificial Sequence; identical to SEQ ID NO: 676
  Description of Artificial Sequence: Synthetic polypeptide

SEQ ID NO: 685 - protein, 249 aa, Artificial Sequence; identical to SEQ ID NO: 681
  Description of Artificial Sequence: Synthetic polypeptide

SEQ ID NO: 686 - protein, 221 aa, Artificial Sequence; identical to SEQ ID NO: 678
  Description of Artificial Sequence: Synthetic polypeptide

SEQ ID NO: 687 - protein, 242 aa, Artificial Sequence; identical to SEQ ID NO: 675
  Description of Artificial Sequence: Synthetic polypeptide

SEQ ID NO: 688 - protein, 228 aa, Artificial Sequence; identical to SEQ ID NO: 680
  Description of Artificial Sequence: Synthetic polypeptide

SEQ ID NO: 689 - protein, 242 aa, Artificial Sequence; identical to SEQ ID NO: 677
  Description of Artificial Sequence: Synthetic polypeptide

SEQ ID NO: 690 - protein, 228 aa, Artificial Sequence; identical to SEQ ID NO: 682
  Description of Artificial Sequence: Synthetic polypeptide

SEQ ID NO: 691 - protein, 243 aa, Artificial Sequence
  Description of Artificial Sequence: Synthetic polypeptide
QVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSSASTKGPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 692 - protein, 221 aa, Artificial Sequence
  Description of Artificial Sequence: Synthetic polypeptide
AIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKRTVAAPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 693 - protein, 243 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPQVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSS

SEQ ID NO: 694 - protein, 221 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPAIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKR

SEQ ID NO: 695 - protein, 250 aa, Artificial Sequence
  Description of Artificial Sequence: Synthetic polypeptide
QVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSSASTKGPSVFPLAPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 696 - protein, 228 aa, Artificial Sequence
  Description of Artificial Sequence: Synthetic polypeptide
AIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKRTVAAPSVFIFPPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 697 - protein, 250 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPQVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSS

SEQ ID NO: 698 - protein, 228 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPAIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKR

SEQ ID NO: 699 - protein, 250 aa, Artificial Sequence; identical to SEQ ID NO: 695
  Description of Artificial Sequence: Synthetic polypeptide

SEQ ID NO: 700 - protein, 221 aa, Artificial Sequence; identical to SEQ ID NO: 692
  Description of Artificial Sequence: Synthetic polypeptide

SEQ ID NO: 701 - protein, 250 aa, Artificial Sequence; identical to SEQ ID NO: 697
  Description of Artificial Sequence: Synthetic polypeptide

SEQ ID NO: 702 - protein, 221 aa, Artificial Sequence; identical to SEQ ID NO: 694
  Description of Artificial Sequence: Synthetic polypeptide

SEQ ID NO: 703 - protein, 243 aa, Artificial Sequence; identical to SEQ ID NO: 691
  Description of Artificial Sequence: Synthetic polypeptide

SEQ ID NO: 704 - protein, 228 aa, Artificial Sequence; identical to SEQ ID NO: 696
  Description of Artificial Sequence: Synthetic polypeptide

SEQ ID NO: 705 - protein, 243 aa, Artificial Sequence; identical to SEQ ID NO: 693
  Description of Artificial Sequence: Synthetic polypeptide

SEQ ID NO: 706 - protein, 228 aa, Artificial Sequence; identical to SEQ ID NO: 698
  Description of Artificial Sequence: Synthetic polypeptide

SEQ ID NO: 707 - protein, 242 aa, Artificial Sequence
  Description of Artificial Sequence: Synthetic polypeptide
QVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 708 - protein, 221 aa, Artificial Sequence
  Description of Artificial Sequence: Synthetic polypeptide
AIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 709 - protein, 242 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPQVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSS

SEQ ID NO: 710 - protein, 221 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPAIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKR

SEQ ID NO: 711 - protein, 249 aa, Artificial Sequence
  Description of Artificial Sequence: Synthetic polypeptide
QVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSSASTKGPSVFPLAPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 712 - protein, 228 aa, Artificial Sequence
  Description of Artificial Sequence: Synthetic polypeptide
AIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKRTVAAPSVFIFPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 713 - protein, 249 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPQVQLKQSGPGLVQPSQSLSITCTVSGFSLTTYGIHWVRQSPGKGLEWLGVMWSGGDTDYDAAFISRLSISKDNSKSQVFFKMNSLQANDTGIYYCARYRFYGMDYWGQGTSVTVSS

SEQ ID NO: 714 - protein, 228 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPAIQMTQSSSSFSVSLGDRVTITCKASEDIYNRFAWYQQKPGNAPRLLISGAASLEAGVPSRFSGSGSGQDYTLSITSLQTEDVATYYCQQYWSTPWTFGGGTKLEIKR

SEQ ID NO: 715 - protein, 249 aa, Artificial Sequence; identical to SEQ ID NO: 711
  Description of Artificial Sequence: Synthetic polypeptide

SEQ ID NO: 716 - protein, 221 aa, Artificial Sequence; identical to SEQ ID NO: 708
  Description of Artificial Sequence: Synthetic polypeptide

SEQ ID NO: 717 - protein, 249 aa, Artificial Sequence; identical to SEQ ID NO: 713
  Description of Artificial Sequence: Synthetic polypeptide

SEQ ID NO: 718 - protein, 221 aa, Artificial Sequence; identical to SEQ ID NO: 710
  Description of Artificial Sequence: Synthetic polypeptide

SEQ ID NO: 719 - protein, 242 aa, Artificial Sequence; identical to SEQ ID NO: 707
  Description of Artificial Sequence: Synthetic polypeptide

SEQ ID NO: 720 - protein, 228 aa, Artificial Sequence; identical to SEQ ID NO: 712
  Description of Artificial Sequence: Synthetic polypeptide

SEQ ID NO: 721 - protein, 242 aa, Artificial Sequence; identical to SEQ ID NO: 709
  Description of Artificial Sequence: Synthetic polypeptide

SEQ ID NO: 722 - protein, 228 aa, Artificial Sequence; identical to SEQ ID NO: 714
  Description of Artificial Sequence: Synthetic polypeptide

SEQ ID NO: 723 - protein, 242 aa, Artificial Sequence
  Description of Artificial Sequence: Synthetic polypeptide
QVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSSASTKGPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 724 - protein, 226 aa, Artificial Sequence
  Description of Artificial Sequence: Synthetic polypeptide
DIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKRTVAAPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 725 - protein, 242 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPQVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSS

SEQ ID NO: 726 - protein, 226 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPDIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKR

SEQ ID NO: 727 - protein, 249 aa, Artificial Sequence
  Description of Artificial Sequence: Synthetic polypeptide
QVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSSASTKGPSVFPLAPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 728 - protein, 233 aa, Artificial Sequence
  Description of Artificial Sequence: Synthetic polypeptide
DIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 729 - protein, 249 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPSVFPLAPQVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSS

SEQ ID NO: 730 - protein, 233 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPDIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKR

SEQ ID NO: 731 - protein, 249 aa, Artificial Sequence; identical to SEQ ID NO: 727
  Description of Artificial Sequence: Synthetic polypeptide

SEQ ID NO: 732 - protein, 226 aa, Artificial Sequence; identical to SEQ ID NO: 724
  Description of Artificial Sequence: Synthetic polypeptide

SEQ ID NO: 733 - protein, 249 aa, Artificial Sequence; identical to SEQ ID NO: 729
  Description of Artificial Sequence: Synthetic polypeptide

SEQ ID NO: 734 - protein, 226 aa, Artificial Sequence; identical to SEQ ID NO: 726
  Description of Artificial Sequence: Synthetic polypeptide

SEQ ID NO: 735 - protein, 242 aa, Artificial Sequence; identical to SEQ ID NO: 723
  Description of Artificial Sequence: Synthetic polypeptide

SEQ ID NO: 736 - protein, 233 aa, Artificial Sequence; identical to SEQ ID NO: 728
  Description of Artificial Sequence: Synthetic polypeptide

SEQ ID NO: 737 - protein, 242 aa, Artificial Sequence; identical to SEQ ID NO: 725
  Description of Artificial Sequence: Synthetic polypeptide

SEQ ID NO: 738 - protein, 233 aa, Artificial Sequence; identical to SEQ ID NO: 730
  Description of Artificial Sequence: Synthetic polypeptide

SEQ ID NO: 739 - protein, 243 aa, Artificial Sequence
  Description of Artificial Sequence: Synthetic polypeptide
QVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSSASTKGPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 740 - protein, 226 aa, Artificial Sequence
  Description of Artificial Sequence: Synthetic polypeptide
DIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKRTVAAPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 741 - protein, 243 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPQVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSS

SEQ ID NO: 742 - protein, 226 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPDIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKR

SEQ ID NO: 743 - protein, 250 aa, Artificial Sequence
  Description of Artificial Sequence: Synthetic polypeptide
QVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSSASTKGPSVFPLAPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 744 - protein, 233 aa, Artificial Sequence
  Description of Artificial Sequence: Synthetic polypeptide
DIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKRTVAAPSVFIFPPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 745 - protein, 250 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPQVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSS

SEQ ID NO: 746 - protein, 233 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPDIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKR

SEQ ID NO: 747 - protein, 250 aa, Artificial Sequence; identical to SEQ ID NO: 743
  Description of Artificial Sequence: Synthetic polypeptide

SEQ ID NO: 748 - protein, 226 aa, Artificial Sequence; identical to SEQ ID NO: 740
  Description of Artificial Sequence: Synthetic polypeptide

SEQ ID NO: 749 - protein, 250 aa, Artificial Sequence; identical to SEQ ID NO: 745
  Description of Artificial Sequence: Synthetic polypeptide

SEQ ID NO: 750 - protein, 226 aa, Artificial Sequence; identical to SEQ ID NO: 742
  Description of Artificial Sequence: Synthetic polypeptide

SEQ ID NO: 751 - protein, 243 aa, Artificial Sequence; identical to SEQ ID NO: 739
  Description of Artificial Sequence: Synthetic polypeptide

SEQ ID NO: 752 - protein, 233 aa, Artificial Sequence; identical to SEQ ID NO: 744
  Description of Artificial Sequence: Synthetic polypeptide

SEQ ID NO: 753 - protein, 243 aa, Artificial Sequence; identical to SEQ ID NO: 741
  Description of Artificial Sequence: Synthetic polypeptide

SEQ ID NO: 754 - protein, 233 aa, Artificial Sequence; identical to SEQ ID NO: 746
  Description of Artificial Sequence: Synthetic polypeptide

SEQ ID NO: 755 - protein, 242 aa, Artificial Sequence
  Description of Artificial Sequence: Synthetic polypeptide
QVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 756 - protein, 226 aa, Artificial Sequence
  Description of Artificial Sequence: Synthetic polypeptide
DIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 757 - protein, 242 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPQVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSS

SEQ ID NO: 758 - protein, 226 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPDIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKR

SEQ ID NO: 759 - protein, 249 aa, Artificial Sequence
  Description of Artificial Sequence: Synthetic polypeptide
QVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSSASTKGPSVFPLAPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 760 - protein, 233 aa, Artificial Sequence
  Description of Artificial Sequence: Synthetic polypeptide
DIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKRTVAAPSVFIFPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 761 - protein, 249 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPQVQLQQSGAELVKPGASVKISCKASGYTFTDYYINWVKLAPGQGLEWIGWIYPGSGNTKYNEKFKGKATLTIDTSSSTAYMQLSSLTSEDTAVYFCVRDSPFFDYWGQGTLLTVSS

SEQ ID NO: 762 - protein, 233 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPDIVLTQSPDSLAVSLGERVTMNCKSSQSLLNSGMRKSFLAWYQQKPGQSPKLLIYWASTRESGVPDRFTGSGSGTDFTLTISSVQAEDVAVYYCKQSYHLFTFGSGTKLEIKR

SEQ ID NO: 763 - protein, 249 aa, Artificial Sequence; identical to SEQ ID NO: 759
  Description of Artificial Sequence: Synthetic polypeptide

SEQ ID NO: 764 - protein, 226 aa, Artificial Sequence; identical to SEQ ID NO: 756
  Description of Artificial Sequence: Synthetic polypeptide

SEQ ID NO: 765 - protein, 249 aa, Artificial Sequence; identical to SEQ ID NO: 761
  Description of Artificial Sequence: Synthetic polypeptide

SEQ ID NO: 766 - protein, 226 aa, Artificial Sequence; identical to SEQ ID NO: 758
  Description of Artificial Sequence: Synthetic polypeptide

SEQ ID NO: 767 - protein, 242 aa, Artificial Sequence; identical to SEQ ID NO: 755
  Description of Artificial Sequence: Synthetic polypeptide

SEQ ID NO: 768 - protein, 233 aa, Artificial Sequence; identical to SEQ ID NO: 760
  Description of Artificial Sequence: Synthetic polypeptide

SEQ ID NO: 769 - protein, 242 aa, Artificial Sequence; identical to SEQ ID NO: 757
  Description of Artificial Sequence: Synthetic polypeptide

SEQ ID NO: 770 - protein, 233 aa, Artificial Sequence; identical to SEQ ID NO: 762
  Description of Artificial Sequence: Synthetic polypeptide

SEQ ID NO: 771 - protein, 255 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPSVFPLAPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 772 - protein, 228 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 773 - protein, 255 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPSVFPLAPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 774 - protein, 228 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 775 - protein, 255 aa, Artificial Sequence; identical to SEQ ID NO: 771
  Description of Artificial Sequence: Synthetic polypeptide

SEQ ID NO: 776 - protein, 221 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 777 - protein, 255 aa, Artificial Sequence; identical to SEQ ID NO: 773
  Description of Artificial Sequence: Synthetic polypeptide

SEQ ID NO: 778 - protein, 221 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 779 - protein, 248 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 780 - protein, 228 aa, Artificial Sequence; identical to SEQ ID NO: 772
  Description of Artificial Sequence: Synthetic polypeptide

SEQ ID NO: 781 - protein, 248 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 782 - protein, 228 aa, Artificial Sequence; identical to SEQ ID NO: 774
  Description of Artificial Sequence: Synthetic polypeptide

SEQ ID NO: 783 - protein, 248 aa, Artificial Sequence; identical to SEQ ID NO: 779
  Description of Artificial Sequence: Synthetic polypeptide

SEQ ID NO: 784 - protein, 221 aa, Artificial Sequence; identical to SEQ ID NO: 776
  Description of Artificial Sequence: Synthetic polypeptide

SEQ ID NO: 785 - protein, 248 aa, Artificial Sequence; identical to SEQ ID NO: 781
  Description of Artificial Sequence: Synthetic polypeptide

SEQ ID NO: 786 - protein, 221 aa, Artificial Sequence; identical to SEQ ID NO: 778
  Description of Artificial Sequence: Synthetic polypeptide

SEQ ID NO: 787 - protein, 256 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPSVFPLAPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 788 - protein, 228 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPSVFIFPPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 789 - protein, 256 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 790 - protein, 228 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 791 - protein, 256 aa, Artificial Sequence; identical to SEQ ID NO: 787
  Description of Artificial Sequence: Synthetic polypeptide

SEQ ID NO: 792 - protein, 221 aa, Artificial Sequence
  Description of Artificial Sequence: Synthetic polypeptide
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKRTVAAPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 793 - protein, 256 aa, Artificial Sequence; identical to SEQ ID NO: 789
  Description of Artificial Sequence: Synthetic polypeptide

SEQ ID NO: 794 - protein, 221 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIKR

SEQ ID NO: 795 - protein, 249 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSSASTKGPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 796 - protein, 228 aa, Artificial Sequence; identical to SEQ ID NO: 788
  Description of Artificial Sequence: Synthetic polypeptide

SEQ ID NO: 797 - protein, 249 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 798 - protein, 228 aa, Artificial Sequence; identical to SEQ ID NO: 790
  Description of Artificial Sequence: Synthetic polypeptide

SEQ ID NO: 799 - protein, 249 aa, Artificial Sequence; identical to SEQ ID NO: 795
  Description of Artificial Sequence: Synthetic polypeptide

SEQ ID NO: 800 - protein, 221 aa, Artificial Sequence; identical to SEQ ID NO: 792
  Description of Artificial Sequence: Synthetic polypeptide

SEQ ID NO: 801 - protein, 249 aa, Artificial Sequence; identical to SEQ ID NO: 797
  Description of Artificial Sequence: Synthetic polypeptide

SEQ ID NO: 802 - protein, 221 aa, Artificial Sequence; identical to SEQ ID NO: 794
  Description of Artificial Sequence: Synthetic polypeptide

SEQ ID NO: 803 - protein, 247 aa, Artificial Sequence
  Description of Artificial Sequence: Synthetic polypeptide
EVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSSASTKGPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 804 - protein, 221 aa, Artificial Sequence
  Description of Artificial Sequence: Synthetic polypeptide
DIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKRTVAAPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 805 - protein, 247 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPEVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSS

SEQ ID NO: 806 - protein, 221 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPDIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKR

SEQ ID NO: 807 - protein, 254 aa, Artificial Sequence
  Description of Artificial Sequence: Synthetic polypeptide
EVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSSASTKGPSVFPLAPEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 808 - protein, 228 aa, Artificial Sequence
  Description of Artificial Sequence: Synthetic polypeptide
DIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKRTVAAPSVFIFPPDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 809 - protein, 254 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPEVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSS

SEQ ID NO: 810 - protein, 228 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPDIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKR

SEQ ID NO: 811 - protein, 254 aa, Artificial Sequence; identical to SEQ ID NO: 807
  Description of Artificial Sequence: Synthetic polypeptide

SEQ ID NO: 812 - protein, 221 aa, Artificial Sequence; identical to SEQ ID NO: 804
  Description of Artificial Sequence: Synthetic polypeptide

SEQ ID NO: 813 - protein, 254 aa, Artificial Sequence; identical to SEQ ID NO: 809
  Description of Artificial Sequence: Synthetic polypeptide

SEQ ID NO: 814 - protein, 221 aa, Artificial Sequence; identical to SEQ ID NO: 806
  Description of Artificial Sequence: Synthetic polypeptide

SEQ ID NO: 815 - protein, 247 aa, Artificial Sequence; identical to SEQ ID NO: 803
  Description of Artificial Sequence: Synthetic polypeptide

SEQ ID NO: 816 - protein, 228 aa, Artificial Sequence; identical to SEQ ID NO: 808
  Description of Artificial Sequence: Synthetic polypeptide

SEQ ID NO: 817 - protein, 247 aa, Artificial Sequence; identical to SEQ ID NO: 805
  Description of Artificial Sequence: Synthetic polypeptide

SEQ ID NO: 818 - protein, 228 aa, Artificial Sequence; identical to SEQ ID NO: 810
  Description of Artificial Sequence: Synthetic polypeptide

SEQ ID NO: 819 - protein, 244 aa, Artificial Sequence
  Description of Artificial Sequence: Synthetic polypeptide
EVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSSASTKGPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 820 - protein, 221 aa, Artificial Sequence
  Description of Artificial Sequence: Synthetic polypeptide
DIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKRTVAAPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 821 - protein, 244 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPEVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSS

SEQ ID NO: 822 - protein, 221 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPDIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKR

SEQ ID NO: 823 - protein, 251 aa, Artificial Sequence
  Description of Artificial Sequence: Synthetic polypeptide
EVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSSASTKGPSVFPLAPEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 824 - protein, 228 aa, Artificial Sequence
  Description of Artificial Sequence: Synthetic polypeptide
DIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKRTVAAPSVFIFPPDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 825 - protein, 251 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPSVFPLAPEVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSS

SEQ ID NO: 826 - protein, 228 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPDIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKR

SEQ ID NO: 827 - protein, 251 aa, Artificial Sequence; identical to SEQ ID NO: 823
  Description of Artificial Sequence: Synthetic polypeptide

SEQ ID NO: 828 - protein, 221 aa, Artificial Sequence; identical to SEQ ID NO: 820
  Description of Artificial Sequence: Synthetic polypeptide

SEQ ID NO: 829 - protein, 251 aa, Artificial Sequence; identical to SEQ ID NO: 825
  Description of Artificial Sequence: Synthetic polypeptide

SEQ ID NO: 830 - protein, 221 aa, Artificial Sequence; identical to SEQ ID NO: 822
  Description of Artificial Sequence: Synthetic polypeptide

SEQ ID NO: 831 - protein, 244 aa, Artificial Sequence; identical to SEQ ID NO: 819
  Description of Artificial Sequence: Synthetic polypeptide

SEQ ID NO: 832 - protein, 228 aa, Artificial Sequence; identical to SEQ ID NO: 824
  Description of Artificial Sequence: Synthetic polypeptide

SEQ ID NO: 833 - protein, 244 aa, Artificial Sequence; identical to SEQ ID NO: 821
  Description of Artificial Sequence: Synthetic polypeptide

SEQ ID NO: 834 - protein, 228 aa, Artificial Sequence; identical to SEQ ID NO: 826
  Description of Artificial Sequence: Synthetic polypeptide

SEQ ID NO: 835 - protein, 245 aa, Artificial Sequence
  Description of Artificial Sequence: Synthetic polypeptide
EVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSSASTKGPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 836 - protein, 221 aa, Artificial Sequence
  Description of Artificial Sequence: Synthetic polypeptide
DIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKRTVAAPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 837 - protein, 245 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPEVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSS

SEQ ID NO: 838 - protein, 221 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPDIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKR

SEQ ID NO: 839 - protein, 252 aa, Artificial Sequence
  Description of Artificial Sequence: Synthetic polypeptide
EVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSSASTKGPSVFPLAPEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 840 - protein, 228 aa, Artificial Sequence
  Description of Artificial Sequence: Synthetic polypeptide
DIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKRTVAAPSVFIFPPDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKR

SEQ ID NO: 841 - protein, 252 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPEVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSS

SEQ ID NO: 842 - protein, 228 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPDIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKR

SEQ ID NO: 843 - protein, 252 aa, Artificial Sequence; identical to SEQ ID NO: 839
  Description of Artificial Sequence: Synthetic polypeptide

SEQ ID NO: 844 - protein, 221 aa, Artificial Sequence; identical to SEQ ID NO: 836
  Description of Artificial Sequence: Synthetic polypeptide

SEQ ID NO: 845 - protein, 252 aa, Artificial Sequence; identical to SEQ ID NO: 841
  Description of Artificial Sequence: Synthetic polypeptide

SEQ ID NO: 846 - protein, 221 aa, Artificial Sequence; identical to SEQ ID NO: 838
  Description of Artificial Sequence: Synthetic polypeptide

SEQ ID NO: 847 - protein, 245 aa, Artificial Sequence; identical to SEQ ID NO: 835
  Description of Artificial Sequence: Synthetic polypeptide

SEQ ID NO: 848 - protein, 228 aa, Artificial Sequence; identical to SEQ ID NO: 840
  Description of Artificial Sequence: Synthetic polypeptide

SEQ ID NO: 849 - protein, 245 aa, Artificial Sequence; identical to SEQ ID NO: 837
  Description of Artificial Sequence: Synthetic polypeptide

SEQ ID NO: 850 - protein, 228 aa, Artificial Sequence; identical to SEQ ID NO: 842
  Description of Artificial Sequence: Synthetic polypeptide

SEQ ID NO: 851 - protein, 245 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 852 - protein, 221 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKR

SEQ ID NO: 853 - protein, 245 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 854 - protein, 221 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 855 - protein, 252 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 856 - protein, 228 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKR

SEQ ID NO: 857 - protein, 252 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 858 - protein, 228 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 859 - protein, 252 aa, Artificial Sequence; identical to SEQ ID NO: 855
  Description of Artificial Sequence: Synthetic polypeptide

SEQ ID NO: 860 - protein, 221 aa, Artificial Sequence; identical to SEQ ID NO: 852
  Description of Artificial Sequence: Synthetic polypeptide

SEQ ID NO: 861 - protein, 252 aa, Artificial Sequence; identical to SEQ ID NO: 857
  Description of Artificial Sequence: Synthetic polypeptide

SEQ ID NO: 862 - protein, 221 aa, Artificial Sequence; identical to SEQ ID NO: 854
  Description of Artificial Sequence: Synthetic polypeptide

SEQ ID NO: 863 - protein, 245 aa, Artificial Sequence; identical to SEQ ID NO: 851
  Description of Artificial Sequence: Synthetic polypeptide

SEQ ID NO: 864 - protein, 228 aa, Artificial Sequence; identical to SEQ ID NO: 856
  Description of Artificial Sequence: Synthetic polypeptide

SEQ ID NO: 865 - protein, 245 aa, Artificial Sequence; identical to SEQ ID NO: 853
  Description of Artificial Sequence: Synthetic polypeptide

SEQ ID NO: 866 - protein, 228 aa, Artificial Sequence; identical to SEQ ID NO: 858
  Description of Artificial Sequence: Synthetic polypeptide

SEQ ID NO: 867 - DNA, 7185 bp, Artificial Sequence
  Description of Artificial Sequence: Synthetic polynucleotide
gcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgccaccatggagtttgggctgagctggctttttcttgtcgcgattttaaaaggtgtccagtgc

SEQ ID NO: 868 - DNA, 6521 bp, Artificial Sequence
  Description of Artificial Sequence: Synthetic polynucleotide
acggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgcaccatggacatgcgcgtgcccgcccagctgctgggcctgctgctgctgtggttccccggctcgcgatgc

SEQ ID NO: 869 - DNA, 6513 bp, Artificial Sequence
  Description of Artificial Sequence: Synthetic polynucleotide
caacccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgccaccatgacttggaccccactcctcttcctcaccctcctcctccactgcacaggaagcttatcg

SEQ ID NO: 870 - DNA, 6515 bp, Artificial Sequence
  Description of Artificial Sequence: Synthetic polynucleotide
acggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgcaccatgacttggaccccactcctcttcctcaccctcctcctccactgcacaggaagcttatcg

SEQ ID NO: 871 - DNA, 6519 bp, Artificial Sequence
  Description of Artificial Sequence: Synthetic polynucleotide
caacccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgccaccatggacatgcgcgtgcccgcccagctgctgggcctgctgctgctgtggttccccggctcgcgatgc

SEQ ID NO: 872 - DNA, 7185 bp, Artificial Sequence
  Description of Artificial Sequence: Synthetic polynucleotide
gcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgcggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgccaccatggagtttgggctgagctggctttttcttgtcgcgattttaaaaggtgtccagtgc

SEQ ID NO: 873 - protein, 5 aa, Artificial Sequence
  Description of Artificial Sequence: Synthetic peptide
GGGGS

We claim:

1. A binding protein comprising first and second polypeptide chains, each independently comprising VD1-(X1)n-VD2-C-(X2)n, wherein
    VD1 is a first variable domain;
    VD2 is a second variable domain;
    C is a constant domain;
    X1 is a linker;
    X2 is an Fc region;
    n is 0 or 1;
wherein the VD1 domains on the first and second polypeptide chains form a first functional target binding site and the VD2 domains on the first and second polypeptide chains form a second functional target binding site, and wherein the binding protein is capable of binding VEGF and DLL4, wherein the first and second polypeptide chains of the binding protein comprise:
    SEQ ID NOs: 239 and 240,
    SEQ ID NOs: 411 and 412,
    SEQ ID NOs: 413 and 414,
    SEQ ID NOs: 419 and 420,
    SEQ ID NOs: 435 and 436,
    SEQ ID NOs: 445 and 446,
    SEQ ID NOs: 449 and 450,
    SEQ ID NOs: 453 and 454,
    SEQ ID NOs: 461 and 462,
    SEQ ID NOs: 465 and 466,
    SEQ ID NOs: 469 and 470,
    SEQ ID NOs: 473 and 474,
    SEQ ID NOs: 475 and 476,
    SEQ ID NOs: 477 and 478,
    SEQ ID NOs: 479 and 480,
    SEQ ID NOs: 481 and 482,
    SEQ ID NOs: 483 and 484,
    SEQ ID NOs: 485 and 486,
    SEQ ID NOs: 489 and 490,
    SEQ ID NOs: 493 and 494,
    SEQ ID NOs: 497 and 498,
    SEQ ID NOs: 501 and 502,
    SEQ ID NOs: 503 and 504,
    SEQ ID NOs: 507 and 508,
    SEQ ID NOs: 509 and 510,
    SEQ ID NOs: 511 and 512,
    SEQ ID NOs: 513 and 514,
    SEQ ID NOs: 517 and 518,
    SEQ ID NOs: 525 and 526,
    SEQ ID NOs: 529 and 530,
    SEQ ID NOs: 533 and 534,
    SEQ ID NOs: 537 and 538,
    SEQ ID NOs: 541 and 542,
    SEQ ID NOs: 543 and 544,
    SEQ ID NOs: 545 and 546,
    SEQ ID NOs: 557 and 558,
    SEQ ID NOs: 559 and 560,
    SEQ ID NOs: 561 and 562,
    SEQ ID NOs: 585 and 586,
    SEQ ID NOs: 589 and 590, or
    SEQ ID NOs: 593 and 594.

2. The binding protein according to claim 1, wherein the first polypeptide chain is a heavy chain and n is 0 or 1 for (X2)n, and wherein the second polypeptide chain is a light chain and n is 0 for (X2)n.

3. The binding protein according to claim 1, wherein the first and second polypeptide chains of the binding protein comprise:
    SEQ ID NOs: 239 and 240,
    SEQ ID NOs: 445 and 446,
    SEQ ID NOs: 449 and 450,
    SEQ ID NOs: 453 and 454,
    SEQ ID NOs: 465 and 466,
    SEQ ID NOs: 473 and 474,
    SEQ ID NOs: 477 and 478,
    SEQ ID NOs: 481 and 482,
    SEQ ID NOs: 485 and 486,
    SEQ ID NOs: 489 and 490,
    SEQ ID NOs: 493 and 494,
    SEQ ID NOs: 497 and 498,
    SEQ ID NOs: 503 and 504,
    SEQ ID NOs: 507 and 508,
    SEQ ID NOs: 509 and 510,
    SEQ ID NOs: 511 and 512,
    SEQ ID NOs: 513 and 514,
    SEQ ID NOs: 517 and 518,
    SEQ ID NOs: 525 and 526,
    SEQ ID NOs: 529 and 530,
    SEQ ID NOs: 533 and 534,
    SEQ ID NOs: 537 and 538,
    SEQ ID NOs: 541 and 542,
    SEQ ID NOs: 543 and 544,
    SEQ ID NOs: 545 and 546,
    SEQ ID NOs: 557 and 558,
    SEQ ID NOs: 559 and 560,
    SEQ ID NOs: 561 and 562,
    SEQ ID NOs: 585 and 586,
    SEQ ID NOs: 589 and 590, or
    SEQ ID NOs: 593 and 594.

4. The binding protein according to claim 1, comprising two first polypeptide chains and two second polypeptide chains and four functional target binding sites.

5. The binding protein according to claim 1, wherein the Fc region is a variant sequence Fc region.

6. The binding protein according to claim 1, wherein the Fc region is an Fc region from an IgG1, IgG2, IgG3, IgG4, IgA, IgM, IgE, or IgD.

7. The binding protein according to claim 1, wherein the binding protein is a crystallized binding protein.

8. A binding protein conjugate comprising a binding protein according to claim 1, the binding protein conjugate further comprising an immunoadhesion molecule, an imaging agent, a therapeutic agent, or a cytotoxic agent.

9. The binding protein conjugate according to claim 8, wherein the imaging agent is a radiolabel, an enzyme, a fluorescent label, a luminescent label, a bioluminescent label, a magnetic label, or biotin.

10. The binding protein conjugate according to claim 9, wherein the radiolabel is $^{3}$H, $^{14}$C, $^{35}$S, $^{90}$Y, $^{99}$Tc, $^{111}$In, $^{125}$I, $^{131}$I, $^{177}$Lu, $^{166}$Ho, or $^{153}$Sm.

11. The binding protein conjugate according to claim 8, wherein the therapeutic or cytotoxic agent is an anti-metabolite, an alkylating agent, an antibiotic, a growth factor, a cytokine, an anti-angiogenic agent, an anti-mitotic agent, an anthracycline, a toxin, or an apoptotic agent.

12. An isolated nucleic acid encoding the binding protein amino acid sequence according to claim 1.

13. A vector comprising the isolated nucleic acid according to claim 12.

14. A host cell comprising the vector according to claim 13.

15. The host cell according to claim 14, wherein the host cell is a prokaryotic cell, *Escherichia coli*, a eukaryotic cell, an animal cell, a plant cell, a fungal cell, a yeast cell, an Sf9 cell, a mammalian cell, an avian cell, an insect cell, a CHO cell or a COS cell.

16. A method of producing a binding protein, comprising culturing the host cell of claim 14 in culture medium under conditions sufficient to produce the binding protein.

17. A pharmaceutical composition comprising the binding protein according to claim 1 and a pharmaceutically acceptable carrier.

18. The pharmaceutical composition according to claim 17, further comprising at least one additional therapeutic agent.

19. A method of determining the presence, amount, or concentration of VEGF and/or DLL4 in a test sample by an immunoassay comprising contacting the test sample with at least one binding protein of claim 1 and at least one detectable label.

20. A kit for assaying a test sample for the presence, amount, or concentration of VEGF and/or DLL4, said kit comprising (a) instructions for assaying the test sample for VEGF and/or DLL4 and (b) at least one binding protein comprising the binding protein of claim 1.

21. The binding protein of claim 1, wherein the first and second polypeptide chains of the binding protein comprise:
SEQ ID NOs: 489 and 490,
SEQ ID NOs: 517 and 518,
SEQ ID NOs: 503 and 504,
SEQ ID NOs: 507 and 508,
SEQ ID NOs: 525 and 526,
SEQ ID NOs: 511 and 512,
SEQ ID NOs: 529 and 530, or
SEQ ID NOs: 543 and 544.

22. The binding protein of claim 1, wherein the first and second polypeptide chains of the binding protein comprise:
SEQ ID NOs: 411 and 412,
SEQ ID NOs: 413 and 414,
SEQ ID NOs: 475 and 476,
SEQ ID NOs: 477 and 478,
SEQ ID NOs: 479 and 480,
SEQ ID NOs: 481 and 482,
SEQ ID NOs: 483 and 484,
SEQ ID NOs: 485 and 486,
SEQ ID NOs: 511 and 512,
SEQ ID NOs: 513 and 514,
SEQ ID NOs: 543 and 544,
SEQ ID NOs: 545 and 546,
SEQ ID NOs: 559 and 560, or
SEQ ID NOs: 561 and 562.

* * * * *